United States Patent
Brown et al.

(10) Patent No.: US 8,518,907 B2
(45) Date of Patent: Aug. 27, 2013

(54) RNA INTERFERENCE MEDIATED INHIBITION OF CATENIN (CADHERIN-ASSOCIATED PROTEIN), BETA 1 (CTNNB1) GENE EXPRESSION USING SHORT INTERFERING NUCLEIC ACID (SINA)

(75) Inventors: Duncan Brown, Berkeley, CA (US); James J. Cunningham, Devon, PA (US); Marian Gindy, North Wales, PA (US); Victoria Pickering, San Mateo, CA (US); Matthew G. Stanton, Marlton, NJ (US); Steven M. Stirdivant, Cary, NC (US); Walter R. Strapps, Doylestown, PA (US)

(73) Assignee: Merck Sharp & Dohme Corp., Rayway, NJ (US)

( * ) Notice: Subject to any disclaimer, the term of this patent is extended or adjusted under 35 U.S.C. 154(b) by 0 days.

(21) Appl. No.: 13/813,465

(22) PCT Filed: Aug. 2, 2011

(86) PCT No.: PCT/US2011/046178
§ 371 (c)(1), (2), (4) Date: Jan. 31, 2013

(87) PCT Pub. No.: WO2012/018754
PCT Pub. Date: Feb. 9, 2012

(65) Prior Publication Data
US 2013/0137752 A1    May 30, 2013

Related U.S. Application Data

(60) Provisional application No. 61/370,064, filed on Aug. 2, 2010.

(51) Int. Cl.
*C12N 15/11* (2006.01)
*A61K 48/00* (2006.01)
*C07H 21/02* (2006.01)
*C07H 21/04* (2006.01)

(52) U.S. Cl.
USPC ........................ 514/44 A; 536/24.5

(58) Field of Classification Search
USPC ........................ 514/44; 536/24.5
See application file for complete search history.

(56) References Cited

U.S. PATENT DOCUMENTS

2010/0137405 A1  6/2010  Jadhav et al.
2010/0145038 A1  6/2010  McSwiggen et al.

FOREIGN PATENT DOCUMENTS

WO     2010075286 A1   7/2010

OTHER PUBLICATIONS

Verma, Un et al., Clinical Cancer Research, vol. 9, (2003), pp. 1291-1300, "Small interfering RNAs against beta-catenin inhibit the in vitro and in vivo growth of colon cancer cells".
Hulsken, J et al., NCBI Accession X87838, Oct. 7, 2008, "*H. sapiens* mRNA for beta-catenin".

*Primary Examiner* — Terra Cotta Gibbs
(74) *Attorney, Agent, or Firm* — Peter Haeberli; Laura M. Ginkel; David A. Muthard

(57) ABSTRACT

The present invention relates to compounds, compositions, and methods for the study, diagnosis, and treatment of traits, diseases and conditions that respond to the modulation of CTNNB1 gene expression and/or activity, and/or modulate a beta-catenin gene expression pathway. Specifically, the invention relates to double-stranded nucleic acid molecules including small nucleic acid molecules, such as short interfering nucleic acid (siNA), short interfering RNA (siRNA), double-stranded RNA (dsRNA), micro-RNA (miRNA), and short hairpin RNA (shRNA) molecules that are capable of mediating or that mediate RNA interference (RNAi) against CTNNB1 gene expression.

17 Claims, 12 Drawing Sheets

B ——————— $N_{X3}$ ——————— $[N]_{X2}$ B -3'

B $(N)_{X1}$ ——————— $N_{X4}$ ——————— $[N]_{X5}$ -5'

N = Nucleotide (optionally non-nucleotide)
X1 and X2 are independently integers from 0 to 4
X3 is an integer from 15 to 30
X4 is an integer from 9 to 30
X5 is an integer from 0 to 6; sum of X4 and X5 is 15–30

Each (N) is independently a 2'-OMe, 2'-F, 2'-deoxy or LNA nucleotide or any combination thereof
Each N is independently a 2'-OMe, 2'-F, ribo-, or 2'-deoxy nucleotide or any combination thereof
Each [N] is independently a 2'-OMe, 2'-F, ribo-, or 2'-deoxy nucleotide or any combination thereof
B = an optional CAP
Optional phosphorothioates, e.g. between (N), (N); N, N; (N), N; or N, [N] or [N], [N] nucleotides

| N_{X3} Y/R | N_{X4} Y/R | [N]_{X5} Y/R |
|---|---|---|
| (5+) 2'-F/OH Optional PS | (5+) 2'-F/OH Optional PS | 2'-OH/OH or 2'-OMe/OH or 2'-F/OH + Optional PS |
| (5+) 2'-OMe/OH Optional PS | (5+) 2'-OMe/OH Optional PS | |
| (5+) 2'-F/H Optional PS | (5+) 2'-F/OMe Optional PS | |
| (5+) 2'-OMe/F Optional PS | (5+) 2'-F/OMe Optional PS | |

(N)_{X1} = 2'-OMe/F/H/LNA + Optional PS
(N)_{X2} = 2'-OM/F/H/LNAe + Optional PS

FIG. 3 n = 0, 1, 2, 3, 4

```
                          11th nucleotide position based on
                        ↓ 5'-end of guide strand
1.  5'-        B-N N N N N N N N N N N N N N N N N (N N)-B  -3'
2.  3'-   B-(N N) N N N N N N N N N N N N N N N N N N N N N  -5'
3.  5'- ----[N N] N N N N N N N N N N N N N N N N N N N N N ------  -3'
```

1. = sense strand (passenger strand)
2. = antisense strand (guide strand)
3. = target polynucleotide sequence The guide strand is complementary to the target sequence and the passenger strand is complementary to the guide strand.
Overhang nucleotides (NN) in the guide strand can be complementary to nucleotides [NN] in target sequence.
Overhang nucleotides (NN) in the passenger strand can comprise nucleotides [NN] in target sequence.
Position N of the passenger strand can comprise a ribonucleotide. For the representative 19 base pair 21 mer duplex shown, position N is 9 nucleotides in from the 3' end of the passenger strand. However, in duplexes of differing length, the position N is determined based on the 5'-end of the guide strand by counting 11 nucleotide positions in from the 5'-terminus of the guide strand and picking the corresponding base paired nucleotide in the passenger strand. Generally, cleavage by Ago2 takes place between positions 10 and 11 as indicated by the arrow.
Representative 2 nucleotide overhangs are shown, but can vary for example from 0 to about 4 nucleotides.
B = terminal cap which can be present or absent
This generalized motif can be applied to all Stab chemistries herein (see Table 6).

FIG.4C

RNA INTERFERENCE MEDIATED INHIBITION OF CATENIN (CADHERIN-ASSOCIATED PROTEIN), BETA 1 (CTNNB1) GENE EXPRESSION USING SHORT INTERFERING NUCLEIC ACID (SINA)

SEQUENCE LISTING

The sequence listing submitted via EFS, in compliance with 37 CFR §1.52(e)(5), is incorporated herein by reference. The sequence listing text file submitted via EFS contains the file "SequenceListingSIRONC2", created on Jul. 25, 2011 which is 2,173,912 bytes in size.

BACKGROUND OF THE INVENTION

Beta catenin (also known as cadherin-associated protein and β-catenin), is a member of the catenin family of cytosolic proteins. β-catenin is encoded by the CTNNB1 gene.

β-catenin is a pivotal player in the Wnt/Wg signaling pathway, mediators of several developmental processes. In the absence of Wnt, glycogen synthase kinase 3 (GSK-3β), a serine/threonine protein kinase constitutively phosphorylates the β-catenin protein. When Wnt is present and binds to any of the family members of the frizzled receptors (Fz), an intracellular signaling protein known as dishevelled (Dsh) is recruited to the membrane and phosphorylated. GSK-3β is inhibited by the activation of Dsh. As a result, β-catenin levels increase in the cytosol and are translocated into the nucleus to perform a variety of functions. β-catenin acts together with the transcription factors TCF and LEF to activate specific target genes involved in different processes.

β-catenin undergoes phosphorylation upon growth factor stimulation resulting in reduced cell adhesion, thereby functioning as a component of adherin junctions which are multiprotein complexes that mediate cell adhesion, cell-cell communication and cytoskeletal anchoring. (Willert et al., 1998, Curr. Opin. Genet. Dev. 8:95-102).

Thompson et al. suggest that β-catenin plays an important role in various aspects of liver biology including liver development (both embryonic and postnatal), liver regeneration following partial hepatectomy, hepatocyte growth factor (HGF)-induced hepatomegaly, liver zonation, and pathogenesis of liver cancer. (Thompson M D., 2007, Hepatology May; 45(5):1298-305).

Wang et al. (2008) have shown that β-catenin can function as an oncogene. (Wang et al., 2008, Cancer Epidemiol. Biomarkers Prev. 17 (8):2101-8). In patients with basal cell carcinoma an increased level in β-catenin is present and leads to the increase in proliferation of related tumors. Mutations in the β-catenin gene are a cause of colorectal cancer (CRC), pilomatrixoma (PTR), medulloblastoma (MDB), hepatoblastoma, and ovarian cancer.

The role of β-catenin in the development of colorectal cancer has been shown to be regulated by the expression product of the APC (adenomatous polyposis of the colon) gene, a tumor suppressor. (Korinek et al., Science, 1997, 275:1784-1787; Morin et al., Science, 1997, 275:1787-1790). The APC protein normally binds β-catenin in conjunction with TCF/LEF forming a transcription factor complex. Morin et al. (Morin et al., Science, 1997, 275:1787-1790) report that APC protein down-regulates the transcriptional activation mediated by β-catenin and Tcf-4 in colon cancer. Their results indicate that the regulation of β-catenin is critical to APC's tumor suppressive effect and that this regulation can be circumvented by mutations in either APC or β-catenin.

Mutations in the β-catenin gene are either truncations that lead to deletion of part of the N-terminus of β-catenin, or point mutations that affect the serine and threonine residues that are targeted by GSK3α/β or CKIα. These mutant β-catenin proteins are refractory to phosphorylation and thus escape proteasomal degradations. Consequently, β-catenin accumulates within affected cells. Stabilized and nuclear-localized β-catenin is a hallmark of nearly all cases of colon cancer. (Clevers, H., 2006, Cell 127:469-480). Morin et al. demonstrated that mutations of β-catenin that altered phosphorylation sites rendered the cells insensitive to APC-mediated down-regulation of β-catenin and that this disrupted mechanism was critical to colorectal tumorigenesis. (Morin et al., 1997, Science 275:1787-1790).

Other studies also report on the detection of mutations in β-catenin in various cancer cell lines (see e.g., Chan et al., 1999, Nature Genet. 21:410-413; Blaker et al., 1999, Genes Chromosomes Cancer 25:399-402; Sagae et al., 1999, Jpn. J. Cancer Res. 90:510-515; Wang et al., 2008, Cancer Epidemiol. Biomarkers Prev. 17(8):2101-8). Additionally, abnormally high amounts of β-catenin have also been found in melanoma cell lines (see e.g., Rubinfeld et al., 1997, Science, 275:1790-1792).

Likewise other cancers, such as hepatocellular carcinoma (HCC), have also been associated with the Wnt/beta-catenin pathway. HCC is a complex and heterogeneous disease accounting for more than 660,000 new cases per year worldwide. Multiple reports have shown that Wnt signaling components are activated in human HCC patients. Activated Wnt signaling and nuclear beta-catenin correlate with recurrence of disease and poor prognosis (Takigawa et al. 2008, Curr Drug Targets November; 9(11):1013-24). Elevated nuclear beta-catenin staining has been documented in 17-66% of HCC patients (Zulehner et al. 2010, Am J Pathol. January; 176(1):472-81; Yu et al. 2009, J Hepatol. May; 50(5):948-57). Merck's internal dataset on ~300 HCC patient tumors generated in collaboration with the Hong Kong University indicates Wnt signaling components are activated in 50% of HCC patients. External data have shown activating beta-catenin mutations in 13-40% of HCC patients, while inactivating Axin 1 or 2 mutations were present in ~10% of HCC patients (Lee et al. 2006, Frontiers in Bioscience May 1:11:1901-1915).

Preclinical studies provide evidence that activation of the Wnt/beta-catenin pathway is important in the generation and maintenance of HCC. Liver-targeted disruption of APC in mice activates beta-catenin signaling and leads to the formation of HCC (Colnot et al. 2004, Proc Natl Acad Sci USA. December 7; 101(49):17216-21). Although overexpression of a beta-catenin mutant lacking the GSK-3beta phosphorylation sites alone is not sufficient for hepatocarcinogenesis (Harada et al. 2002, Cancer Res. April 1; 62(7):1971-7.), overexpression of tumorigenic mutant beta-catenin has been shown to make mice susceptible to HCC induced by DEN (diethylnitrosamine), a known carcinogen (Nejak-Bowen et al. 2010, Hepatology 2010 May; 51(5):1603-13. Interestingly, 95% of HCC tumors initiated by overexpression of the human Met receptor in mice (Tre-Met transgenic mouse model) harbor beta-catenin activating mutations (Tward et al. 2007, Proc Natl Acad Sci USA. September 11; 104(37):14771-6). This finding reflects the human disease and suggests that the Wnt pathway cooperates with Met signaling during hepatocarcinogenesis. High rates of beta-catenin activating mutations are also found in other transgenic mouse models for HCC (16% beta-catenin mutations in FGF19, 55% in c-Myc and 41% in H-Ras transgenic mice)

(Nicholes et al. 2002, *Am J Pathol*. June; 160(6):2295-307 de la Coste et al. 1998, *Proc Natl Acad Sci USA*. July 21; 95(15): 8847-51).

Preclinical studies have also shown that beta-catenin is a valid target for HCC. Beta-catenin siRNAs inhibit proliferation and viability of human HCC cell lines (Zeng et al. 2007). Similarly, treatment of human HCC cell lines with an anti-Wnt-1 antibody or TCF4/beta-catenin antagonists induce apoptosis, reduction of c-Myc, cyclin D1 and survivin expression as well as suppress tumor growth in vivo (Wei et al. 2009, *Mol Cancer* September 24; 8:76; Wei et al. 2010, *Int J Cancer*. May 15; 126(10):2426-36.2010).

Hepatocellular carcinoma (HCC) is a common and aggressive cancer for which effective therapies are lacking. The Wnt/beta-catenin pathway is activated in a high proportion of HCC cases (~50%), frequently owing to mutations in beta-catenin (i.e. CTNNB1) or in the beta-catenin destruction complex (e.g. Axin1). Moreover, the Wnt pathway as a target has proven to be challenging and is currently undruggable by small molecule inhibitors, making beta-catenin an attractive target for an RNAi-based therapeutic approach (Llovet et al. 2008, *Hepatology* October: 48: 1312-1327).

Alteration of gene expression, specifically CTNNB1 gene expression, through RNA interference (hereinafter "RNAi") is one approach for meeting this need. RNAi is induced by short single-stranded RNA ("siRNA") or double-stranded RNA ("dsRNA") molecules. The short dsRNA molecules, called "short interfering nucleic acids ("siNA")" or "short interfering RNA" or "siRNA" or "RNAi inhibitors" silence the expression of messenger RNAs ("mRNAs") that share sequence homology to the siNA. This can occur via cleavage of the mRNA mediated by an endonuclease complex containing a siNA, commonly referred to as an RNA-induced silencing complex (RISC). Cleavage of the target RNA typically takes place in the middle of the region complementary to the guide sequence of the siNA duplex (Elbashir et al., 2001, *Genes Dev.*, 15:188). In addition, RNA interference can also involve small RNA (e.g., micro-RNA or miRNA) mediated gene silencing, presumably through cellular mechanisms that either inhibit translation or that regulate chromatin structure and thereby prevent transcription of target gene sequences (see for example Allshire, 2002, *Science*, 297:1818-1819; Volpe et al., 2002, *Science*, 297:1833-1837; Jenuwein, 2002, *Science*, 297:2215-2218; and Hall et al., 2002, *Science*, 297: 2232-2237). Despite significant advances in the field of RNAi, there remains a need for agents that can inhibit CTNNB1 gene expression and that can treat disease associated with CTNNB1 expression such as cancer.

SUMMARY OF THE INVENTION

The invention provides a solution to the problem of treating diseases that respond to the modulation of the CTNNB1 gene expression using novel short interfering nucleic acid (siNA) molecules to modulate CTNNB1 expression.

The present invention provides compounds, compositions, and methods useful for modulating the expression of CTNNB1 genes, specifically those CTNNB1 genes associated with cancer and for treating such conditions by RNA interference (RNAi) using small nucleic acid molecules.

In particular, the instant invention features small nucleic acid molecules, i.e., short interfering nucleic acid (siNA) molecules including, but not limited to, short interfering RNA (siRNA), double-stranded RNA (dsRNA), micro-RNA (miRNA), short hairpin RNA (shRNA) and circular RNA molecules and methods used to modulate the expression of CTNNB1 genes and/or other genes involved in pathways of CTNNB1 gene expression and/or activity.

In one aspect, the invention provides double-stranded short interfering nucleic acid (siNA) molecules that inhibit the expression of a CTNNB1 gene in a cell or mammal, wherein the double-stranded siNAs comprise a sense and an antisense stand. The antisense strand comprises a sequence that is complementary to at least a part of an RNA associated with the expression of the CTNNB1 gene. The sense strand comprises a sequence that is complementary to the antisense strand. In various embodiments, at least one strand comprises at least a 15 nucleotide sequence selected from the group of sequences consisting of SEQ ID NOS:1-6374. In certain embodiments, the antisense strand comprises at least 15, 16, 17, 18, or 19 nucleotides having sequence complementarity to a target sequence set forth in Table 1a. In other and/or in the same embodiments, the antisense strand comprises at least a 15, 16, 17, 18, or 19 nucleotide sequence of one of the antisense sequences set forth in Table 1b. In some embodiments, the sense strand comprises at least a 15, 16, 17, 18, or 19 nucleotide sequence of a sense strand sequence as set forth in Table 1b.

In certain embodiments of this aspect of the invention, double-stranded short interfering nucleic acid (siNA) molecules are provided wherein the antisense stand comprises a modified sequence as set forth in Table 1c that has sequence complementarity to a target sequence of the invention. In some embodiments, the sense strand also comprises a modified sequence as set forth in Table 1c.

In certain embodiments, the present invention provides a double-stranded short interfering nucleic acid (siNA) molecule that modulates the expression of CTNNB1, wherein the siNA comprises a sense strand and an antisense strand; each strand is independently 15 to 30 nucleotides in length; and the antisense strand comprises at least 15, 16, 17, 18, or 19 nucleotides having sequence complementary to any of:

5'-CUGUUGGAUUGAUUCGAAA-3' (SEQ ID NO: 5);
5'-ACGACUAGUUCAGUUGCUU-3' (SEQ ID NO: 194);
5'-GGAUGAUCCUAGCUAUCGU-3' (SEQ ID NO: 196); or
5'-CCAGGAUGAUCCUAGCUAU-3' (SEQ ID NO: 151).

In some embodiments of the invention, the antisense strand of a siNA molecule comprises at least a 15, 16, 17, 18, or 19 nucleotide sequence of:

5'-UUUCGAAUCAAUCCAACAG-3' (SEQ ID NO: 4918);
5'-AAGCAACUGAACUAGUCGU-3' (SEQ ID NO: 5107);
5'-ACGAUAGCUAGGAUCAUCC-3' (SEQ ID NO: 5109); or
5'-AUAGCUAGGAUCAUCCUGG-3' (SEQ ID NO: 5064);

In some embodiments, the sense strand of a siNA molecule of the invention comprises at least a 15, 16, 17, 18, or 19 nucleotide sequence of:

5'-CUGUUGGAUUGAUUCGAAA-3' (SEQ ID NO: 5);
5'-ACGACUAGUUCAGUUGCUU-3' (SEQ ID NO: 194);
5'-GGAUGAUCCUAGCUAUCGU-3' (SEQ ID NO: 196); or
5'-CCAGGAUGAUCCUAGCUAU-3' (SEQ ID NO: 151).

In some embodiments, a siNA molecule of the invention comprises any of:

5'-CUGUUGGAUUGAUUCGAAA-3' (SEQ ID NO: 5) and 5'-UUUCGAAUCAAUCCAACAG-3' (SEQ ID NO: 4918); or 5'-ACGACUAGUUCAGUUGCUU-3' (SEQ ID NO: 194) and 5'-AAGCAACUGAACUAGUCGU-3' (SEQ ID NO: 5107); or 5'-GGAUGAUCCUAGCUAUCGU-3' (SEQ ID NO: 196) and 5'-ACGAUAGCUAGGAUCAUCC-3' (SEQ ID NO: 5109); or 5'-CCAGGAUGAUCCUAGCUAU-3' (SEQ ID NO: 151) and 5'-AUAGCUAGGAUCAUCCUGG-3' (SEQ ID NO: 5064).

In some embodiments, a siNA molecule of the invention comprises SEQ ID NOS: 6372 and 6374.

In some embodiments, a siNA molecule of the invention comprises SEQ ID NOS: 6370 and 6369.

In some embodiments, a siNA molecule of the invention comprises SEQ ID NOS: 2021 and 2068.

In some embodiments, a siNA molecule of the invention comprises SEQ ID NOS: 6372 and 6373.

In some embodiments, a siNA molecule of the invention comprises SEQ ID NOS: 2147 and 6368

In some embodiments, the invention features a composition comprising:
- (a) a double-stranded short interfering nucleic acid (siNA) of the invention;
- (b) a cationic lipid compound having any of compound numbers 1-46 or any combination thereof;
- (c) cholesterol;
- (d) DSPC; and
- (e) PEG-DMG.

In some embodiments, the invention features a composition comprising:
- (a) a double-stranded short interfering nucleic acid (siNA) of the invention;
- (b) (13Z,16Z)—N,N-dimethyl-3-nonyldocosa-13,16-dien-1-amine;
- (c) cholesterol;
- (d) DSPC; and
- (e) PEG-DMG.

In some embodiments, the invention features a composition comprising:
- (a) a double-stranded short interfering nucleic acid (siNA) having SEQ ID NOS: 6372 and 6374;
- (b) (13Z,16Z)—N,N-dimethyl-3-nonyldocosa-13,16-dien-1-amine;
- (c) cholesterol;
- (d) DSPC; and
- (e) PEG-DMG.

In some embodiments, the invention features a composition comprising:
- (a) a double-stranded short interfering nucleic acid (siNA) having SEQ ID NOS: 6370 and 6369;
- (b) (13Z,16Z)—N,N-dimethyl-3-nonyldocosa-13,16-dien-1-amine;
- (c) cholesterol;
- (d) DSPC; and
- (e) PEG-DMG.

In some embodiments, the invention features a composition comprising:
- (a) a double-stranded short interfering nucleic acid (siNA) having SEQ ID NOS: 2021 and 2068;
- (b) (13Z,16Z)—N,N-dimethyl-3-nonyldocosa-13,16-dien-1-amine;
- (c) cholesterol;
- (d) DSPC; and
- (e) PEG-DMG.

In some embodiments, the invention features a composition comprising:
- (a) a double-stranded short interfering nucleic acid (siNA) having SEQ ID NOS: 6372 and 6373;
- (b) (13Z,16Z)—N,N-dimethyl-3-nonyldocosa-13,16-dien-1-amine;
- (c) cholesterol;
- (d) DSPC; and
- (e) PEG-DMG.

In some embodiments, the invention features a composition comprising:
- (a) a double-stranded short interfering nucleic acid (siNA) having SEQ ID NOS: 2147 and 6368;
- (b) (13Z,16Z)—N,N-dimethyl-3-nonyldocosa-13,16-dien-1-amine;
- (c) cholesterol;
- (d) DSPC; and
- (e) PEG-DMG.

In some embodiments, a composition of the invention comprises any Cationic Lipid having any of compound numbers 1-46 in the following molar ratios:

Cationic Lipid/Cholesterol/PEG-DMG 56.6/38/5.4;
Cationic Lipid/Cholesterol/PEG-DMG 60/38/2;
Cationic Lipid/Cholesterol/PEG-DMG 67.3/29/3.7;
Cationic Lipid/Cholesterol/PEG-DMG 49.3/47/3.7;
Cationic Lipid/Cholesterol/PEG-DMG 50.3/44.3/5.4;
Cationic Lipid/Cholesterol/PEG-C-DMA/DSPC 40/48/2/10;
Cationic Lipid/Cholesterol/PEG-DMG/DSPC 40/48/2/10; and
Cationic Lipid/Cholesterol/PEG-DMG/DSPC 58/30/2/10.

In some embodiments, a composition of the invention comprises (13Z,16Z)—N,N-dimethyl-3-nonyldocosa-13,16-dien-1-amine, cholesterol, DSPC, and PEG-DMG, having a molar ratio of 50:30:10:2 respectively.

In some embodiments, a composition of the invention further comprises a cryoprotectant. In some embodiments, the cryoprotectant is Sucrose, Trehalose, Raffinose, Stachyose, Verbascose, Mannitol, Glucose, Lactose, Maltose, Maltotriose-heptaose, Dextran, Hydroxyethyl Starch, Insulin, Sorbitol, Glycerol, Arginine, Histidine, Lysine, Proline, Dimethylsulfoxide or any combination thereof. In some embodiments, the cryoprotectant is Sucrose. In some embodiments, the cryoprotectant is Trehalose. In some embodiments, the cryoprotectant is a combination of Sucrose and Trehalose.

In some embodiments of the invention, all of the nucleotides of siNAs of the invention are unmodified. In other embodiments, one or more (e.g., 1, 2, 3, 4, 5, 6, 7, 8, 9, 10, 11, 12, 13, 14, 15, 16, 17, 18, 19, 20, 21, 22, 23, 24, 25, 26, 27, 28, 29, or 30) of the nucleotide positions independently in either one or both strands of an siNA molecule are modified. Modifications include nucleic acid sugar modifications, base modifications, backbone (internucleotide linkage) modifications, non-nucleotide modifications, and/or any combination thereof. In certain instances, purine and pyrimidine nucleotides are differentially modified. For example, purine and pyrimidine nucleotides can be differentially modified at the 2'-sugar position (i.e., at least one purine has a different modification from at least one pyrimidine in the same or different strand at the 2'-sugar position). In certain instances the purines are unmodified in one or both strands, while the pyrimidines in one or both strands are modified. In certain other instances, the pyrimidines are unmodified in one or both strands, while the purines in one or both strands are modified. In some instances, at least one modified nucleotide is a 2'-deoxy-2'-fluoro nucleotide, a 2'-deoxy nucleotide, or a 2'-O-alkyl nucleotide. In some instances, at least 5 or more of the pyrimidine nucleotides in one or both stands are either all 2'-deoxy-2'-fluoro or all 2'-O-methylpyrimidine nucleotides.

In some instances, at least 5 or more of the purine nucleotides in one or both stands are either all 2'-deoxy-2'-fluoro or all 2'-O-methyl purine nucleotides. In certain instances, wherein the siNA molecules comprise one or more modifications as described herein, the nucleotides at positions 1, 2, and 3 at the 5' end of the guide (antisense) strand are unmodified.

In certain embodiments, the siNA molecules of the invention have 3' overhangs of one, two, three, or four nucleotide(s) on one or both of the strands. In other embodiments, the siNA molecules lack overhangs (i.e., have blunt ends). Preferably, the siNA molecule has 3' overhangs of two nucleotides on both the sense and antisense strands. The overhangs can be modified or unmodified. Examples of modified nucleotides in the overhangs include, but are not limited to, 2'-O-alkyl nucleotides, 2'-deoxy-2'-fluoro nucleotides, locked nucleic acid (LNA) nucleotides, or 2'-deoxy nucleotides. The overhang nucleotides in the antisense strand can comprise nucleotides that are complementary to nucleotides in the CTNNB1 target sequence. Likewise, the overhangs in the sense stand can comprise nucleotides that are in the CTNNB1 target sequence. In certain instances, the siNA molecules of the invention have two 3' overhang nucleotides on the antisense stand that are 2'-O-alkyl (e.g., 2'-O-methyl) nucleotides and two 3' overhang nucleotides on the sense stand that are 2'-deoxy nucleotides. In other instances, the siNA molecules of the invention have two 3' overhang nucleotides that are 2'-O-alkyl (e.g., 2'-O-methyl) nucleotides on both the antisense stand and on the sense stand. In certain embodiments, the 2'-O-alkyl nucleotides are 2'-O-methyl uridine nucleotides. In certain instances, the overhangs also comprise one or more phosphorothioate linkages between nucleotides of the overhang.

In some embodiments, the siNA molecules of the invention have caps (also referred to herein as "terminal caps." The cap can be present at the 5'-terminus (5'-cap) or at the 3'-terminus (3'-cap) or can be present on both termini, such as at the 5' and 3' termini of the sense strand of the siNA.

In some embodiments, the siNA molecules of the invention are phosphorylated at the 5' end of the antisense strand. The phosphate group can be a phosphate, a diphosphate or a triphosphate.

The siNA molecules of the invention when double stranded can be symmetric or asymmetric. Each strand of these double stranded siNAs independently can range in nucleotide length between 3 and 30 nucleotides. Generally, each strand of the siNA molecules of the invention is about 15 to 30 (i.e., about 19, 20, 21, 22, 23 or 24) nucleotides in length.

The siNA molecules of the invention, which are double stranded or have a duplex structure, independently comprise about 3 to about 30 (e.g., about 3, 4, 5, 6, 7, 8, 9, 10, 11, 12, 13, 14, 15, 16, 17, 18, 19, 20, 21, 22, 23, 24, 25, 26, 27, 28, 29, or 30) base pairs. Generally, the duplex structure of siNAs of the invention is between 15 and 30, more generally between 18 and 25, yet more generally between 19 and 24, and most generally between 19 and 21 base pairs in length.

In certain embodiments, double-stranded short interfering nucleic acid (siNA) molecules are provided, wherein the molecule has a sense strand and an antisense strand and comprises formula (A):

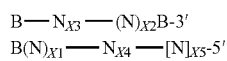

(A)

wherein, the upper strand is the sense strand and the lower strand is the antisense strand of the double-stranded nucleic acid molecule; wherein the antisense strand comprises at least a 15, 16, 17, 18, or 19 nucleotide sequence of SEQ ID NO: 4918, SEQ ID NO: 5107, SEQ ID NO: 5109, or SEQ ID NO: 5064, and the sense strand comprises a sequence having complementarity to the antisense strand;

each N is independently a nucleotide which is unmodified or chemically modified or a non-nucleotide;

each B is a terminal cap that is present or absent;

(N) represents overhanging nucleotides, each of which is independently unmodified or chemically modified;

[N] represents nucleotides that are ribonucleotides;

X1 and X2 are independently integers from 0 to 4;

X3 is an integer from 15 to 30;

X4 is an integer from 9 to 30; and

X5 is an integer from 0 to 6, provided that the sum of X4 and X5 is 15-30.

In one embodiment, the invention features a double-stranded short interfering nucleic acid (siNA) of formula (A); wherein (a) one or more pyrimidine nucleotides in $N_{X4}$ positions are independently 2'-deoxy-2'-fluoro nucleotides, 2'-O-alkyl nucleotides, 2'-deoxy nucleotides, ribonucleotides, or any combination thereof;

(b) one or more purine nucleotides in $N_{X4}$ positions are independently 2'-deoxy-2'-fluoro nucleotides, 2'-O-alkyl nucleotides, 2'-deoxy nucleotides, ribonucleotides, or any combination thereof;

(c) one or more pyrimidine nucleotides in $N_{X3}$ positions are independently 2'-deoxy-2'-fluoro nucleotides, 2'-O-alkyl nucleotides, 2'-deoxy nucleotides, ribonucleotides, or any combination thereof; and (d) one or more purine nucleotides in $N_{X3}$ positions are independently 2'-deoxy-2'-fluoro nucleotides, 2'-O-alkyl nucleotides, 2'-deoxy nucleotides, ribonucleotides, The present invention further provides compositions comprising the double-stranded nucleic acid molecules described herein with optionally a pharmaceutically acceptable carrier or diluent.

The administration of the composition can be carried out by known methods, wherein the nucleic acid is introduced into a desired target cell in vitro or in vivo.

Commonly used techniques for introduction of the nucleic acid molecules of the invention into cells, tissues, and organisms include the use of various carrier systems, reagents and vectors. Non-limiting examples of such carrier systems suitable for use in the present invention include conjugates, nucleic-acid-lipid particles, lipid nanoparticles (LNP), liposomes, lipoplexes, micelles, virosomes, virus like particles (VLP), nucleic acid complexes, and mixtures thereof.

The compositions of the invention can be in the form of an aerosol, dispersion, solution (e.g., an injectable solution), a cream, ointment, tablet, powder, suspension or the like. These compositions may be administered in any suitable way, e.g. orally, sublingually, buccally, parenterally, nasally, or topically. In some embodiments, the compositions are aerosolized and delivered via inhalation.

The molecules and compositions of the present invention have utility over a broad range of therapeutic applications. Accordingly another aspect of this invention relates to the use of the compounds and compositions of the invention in treating a subject. The invention thus provides a method for treating a subject, such as a human, suffering from a condition which is mediated by the action, or by the loss of action, of CTNNB1, wherein the method comprises administering to the subject an effective amount of a double-stranded short interfering nucleic acid (siNA) molecule of the invention. In certain embodiments, the condition is cancer.

These and other aspects of the invention will be apparent upon reference to the following detailed description and attached figures. Moreover, it is contemplated that any method or composition described herein can be implemented with respect to any other method or composition described herein and that different embodiments may be combined.

Additionally, patents, patent applications, and other documents are cited throughout the specification to describe and more specifically set forth various aspects of this invention. Each of these references cited herein is hereby incorporated by reference in its entirety, including the drawings.

BRIEF DESCRIPTION OF THE DRAWINGS

FIG. 2 shows non-limiting examples of chemically modified siNA constructs of the present invention using a generalized structure of a representative siNA duplex. The specific modifications shown in the figure can be utilized alone or in combination with other modifications of the figure, in addition to other modifications and features described herein with reference to any siNA molecule of the invention. In the figure, N stands for any nucleotide or optionally a non-nucleotide as described here. The upper strand, having B-$N_{X3}$-$(N)_{X2}$-B-3' is the sense (or passenger) strand of the siNA, whereas the lower strand, having B$(N)_{X1}$-$N_{X4}$-$[N]_{X5}$-5' is the antisense (or guide) strand of the siNA. Nucleotides (or optional non-nucleotides) of internal portions of the sense strand are designated $N_{X3}$ and nucleotides (or optional non-nucleotides) of internal portions of the antisense strand are designated $N_{X4}$. Nucleotides (or optional non-nucleotides) of the internal portions are generally base paired between the two strands, but can optionally lack base pairing (e.g. have mismatches or gaps) in some embodiments. Nucleotides (or optional non-nucleotides) of overhang regions are designated by parenthesis (N). Nucleotides of the 5'-terminal portion of the antisense strand are designated [N]. Terminal caps are optionally present at the 5' and/or 3' end of the sense strand and further optionally present at the 3'-end of the antisense strand. Generally, each strand can independently range from about 15 to about 30 nucleotides in length, but can vary depending on the presence of any overhang nucleotides. In certain embodiments, X1 and X2 are independently integers from 0 to 4; X3 is an integer from 15 to 30; X4 is an integer from 9 to 30; X5 is an integer from 0 to 6, provided that the sum of X4 and X5 is 15-30. Various modifications are shown for the nucleotides of the sense and antisense strands of the siNA constructs. The (N) overhang nucleotide positions can be chemically modified as described herein (e.g., 2'-O-methyl, 2'-deoxy-2'-fluoro, 2'-deoxy, LNA, universal bases etc.) and can be either derived from a corresponding target nucleic acid sequence or not. The constructs shown in the figure can also comprise phosphorothioate linkages as described herein. For example, phosphorothioate linkages can exist between any N, (N), and/or [N] positions. Such phosphorothioate incorporation can be utilized between purine "R" and pyrimidine "Y" positions, or for stabilization of pyrimidine linkages in general. Furthermore, although not depicted on the Figure, the constructs shown in the figure can optionally include a ribonucleotide at the $9^{th}$ position from the 5'-end of the sense strand or the $11^{th}$ position based on the 5'-end of the guide strand by counting 11 nucleotide positions in from the 5'-terminus of the guide strand. Similarly, the antisense strand can include a ribonucleotide at the $14^{th}$ position from the 5'-end, or alternately can be selected or designed so that a 2'-O-alkyl nucleotide (e.g., a 2'-O-methyl purine) is not present at this position. Furthermore, although not shown in the Figure, the 5'-terminal position of the antisense strand can comprise a terminal phosphate group as described herein. The antisense strand generally comprises sequence complementary to any target nucleic acid sequence of the invention, such as those set forth in Table 1a herein.

FIG. 3 shows non-limiting examples of certain combinations of modifications applied to the representative siNA duplex described in FIG. 2. The table shown below the representative structure provides specific combinations of $(N)_{X1}$, $(N)_{X2}$, $N_{X3}$, $N_{X4}$, and/or $[N]_{X5}$ nucleotide (and optional non-nucleotide) positions. For example, combinations of 5 or more (e.g., 5, 6, 7, 8, 9, or 10 or more) $N_{X3}$ and 5 or more (e.g., 5, 6, 7, 8, 9, or 10 or more) $N_{X4}$ pyrimidine "Y" and purine "R" nucleotides are specified, each of which can independently have specific $(N)_{X1}$, and/or $(N)_{X2}$, substitutions as shown in the figure, in addition to optional phosphorothioate substitutions. The 5'-terminal antisense strand [N] nucleotides are generally ribonucleotides, but can also be modified or unmodified depending on if they are purine "R" or pyrimidine "Y" nucleotides FIGS. 4A-C shows non-limiting examples of different siNA constructs of the invention. The criteria of the representative structures shown in FIGS. 2 and 3 can be applied to any of the structures shown in FIGS. 4A-C.

Figure 1:
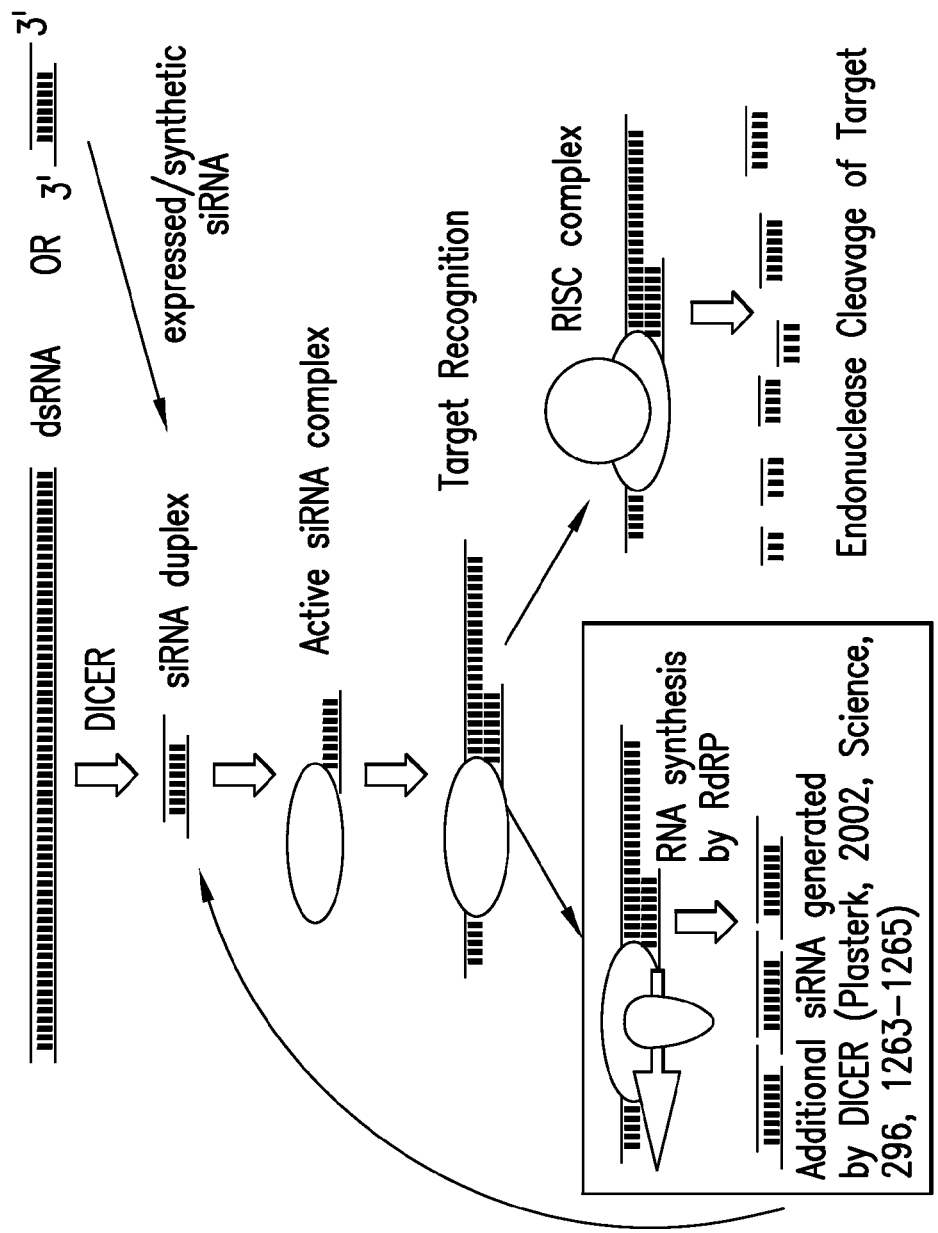
FIG. 1 shows a non-limiting proposed mechanistic representation of target RNA degradation involved in RNAi. Double-stranded RNA (dsRNA), which is generated by RNA-dependent RNA polymerase (RdRP) from foreign single-stranded RNA, for example viral, transposon, or other exogenous RNA, activates the DICER enzyme that in turn generates siNA duplexes. Alternately, synthetic or expressed siNA can be introduced directly into a cell by appropriate means. An active siNA complex forms that recognizes a target RNA, resulting in degradation of the target RNA by the RISC endonuclease complex or in the synthesis of additional RNA by RNA-dependent RNA polymerase (RdRP), which can activate DICER and result in additional siNA molecules, thereby amplifying the RNAi response.
Figure 4A:
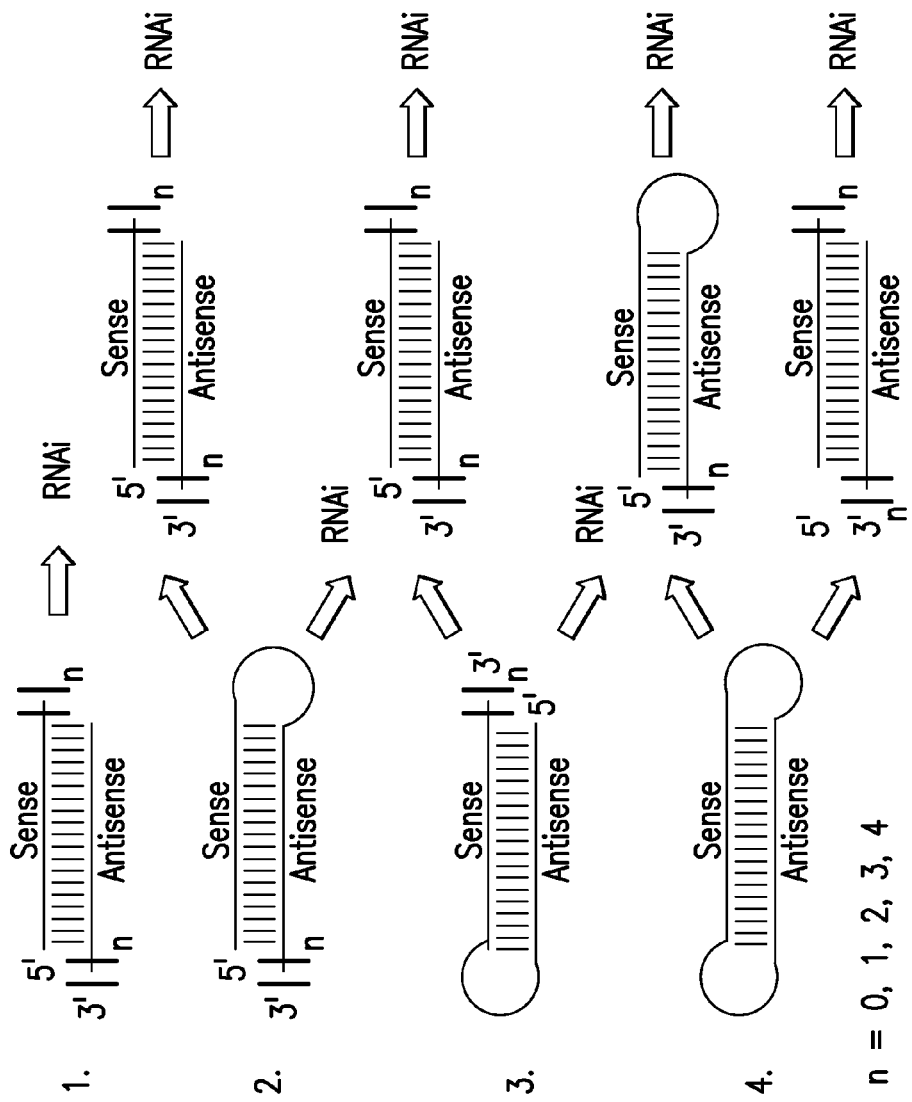

The examples shown in FIG. 4A (constructs 1, 2, and 3) have 19 representative base pairs; however, different embodiments of the invention include any number of base pairs described herein. Bracketed regions represent nucleotide overhangs, for example, comprising about 1, 2, 3, or 4 nucleotides in length, preferably about 2 nucleotides. Constructs 1 and 2 can be used independently for RNAi activity. Construct 2 can comprise a polynucleotide or non-nucleotide linker, which can optionally be designed as a biodegradable linker. In one embodiment, the loop structure shown in construct 2 can comprise a biodegradable linker that results in the formation of construct 1 in vivo and/or in vitro. In another example, construct 3 can be used to generate construct 2 under the same principle wherein a linker is used to generate the active siNA construct 2 in vivo and/or in vitro, which can optionally utilize another biodegradable linker to generate the active siNA construct 1 in vivo and/or in vitro. As such, the stability and/or activity of the siNA constructs can be modulated based on the design of the siNA construct for use in vivo or in vitro and/or in vitro.

Figure 4B:
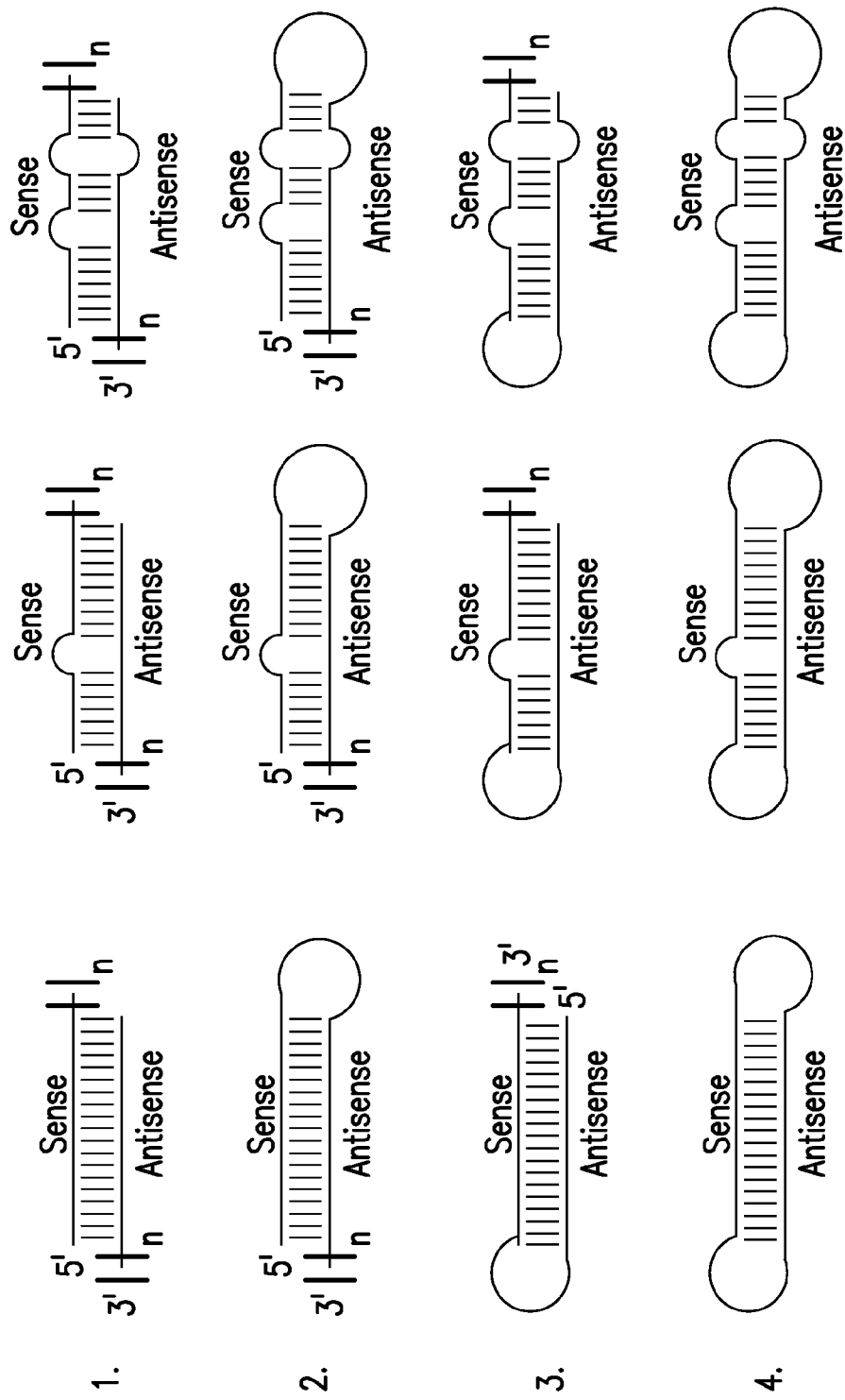

The examples shown in FIG. 4B represent different variations of double-stranded nucleic acid molecule of the invention, such as microRNA, that can include overhangs, bulges, loops, and stem-loops resulting from partial complementarity. Such motifs having bulges, loops, and stem-loops are generally characteristics of miRNA. The bulges, loops, and stem-loops can result from any degree of partial complementarity, such as mismatches or bulges of about 1, 2, 3, 4, 5, 6, 7, 8, 9, 10 or more nucleotides in one or both strands of the double-stranded nucleic acid molecule of the invention.

The example shown in FIG. 4C represents a model double-stranded nucleic acid molecule of the invention comprising a 19 base pair duplex of two 21 nucleotide sequences having dinucleotide 3'-overhangs. The top strand (1) represents the sense strand (passenger strand), the middle strand (2) represents the antisense (guide strand), and the lower strand (3) represents a target polynucleotide sequence. The dinucleotide overhangs (NN) can comprise a sequence derived from the target polynucleotide. For example, the 3'-(NN) sequence in the guide strand can be complementary to the 5'-[NN] sequence of the target polynucleotide. In addition, the 5'-(NN) sequence of the passenger strand can comprise the same sequence as the 5'-[NN] sequence of the target polynucleotide sequence. In other embodiments, the overhangs (NN) are not derived from the target polynucleotide sequence, for example where the 3'-(NN) sequence in the guide strand are not complementary to the 5'-[NN] sequence of the target polynucleotide and the 5'-(NN) sequence of the passenger strand can comprise different sequence from the 5'-[NN] sequence of the target polynucleotide sequence. In additional embodiments, any (NN) nucleotides are chemically modified, e.g., as 2'-O-methyl, 2'-deoxy-2'-fluoro, and/or other modifications herein. Furthermore, the passenger strand can comprise a ribonucleotide position N of the passenger strand. For the representative 19 base pair 21 mer duplex shown, position N can be 9 nucleotides in from the 3' end of the passenger strand. However, in duplexes of differing length, the position N is determined based on the 5'-end of the guide strand by counting 11 nucleotide positions in from the 5'-terminus of the guide strand and picking the corresponding base paired nucleotide in the passenger strand. Cleavage by Ago2 takes place between positions 10 and 11 as indicated by the arrow. In additional embodiments, there are two ribonucleotides, NN, at positions 10 and 11 based on the 5'-end of the guide strand by counting 10 and 11 nucleotide positions in from the 5'-terminus of the guide strand and picking the corresponding base paired nucleotides in the passenger strand.

Figure 5:
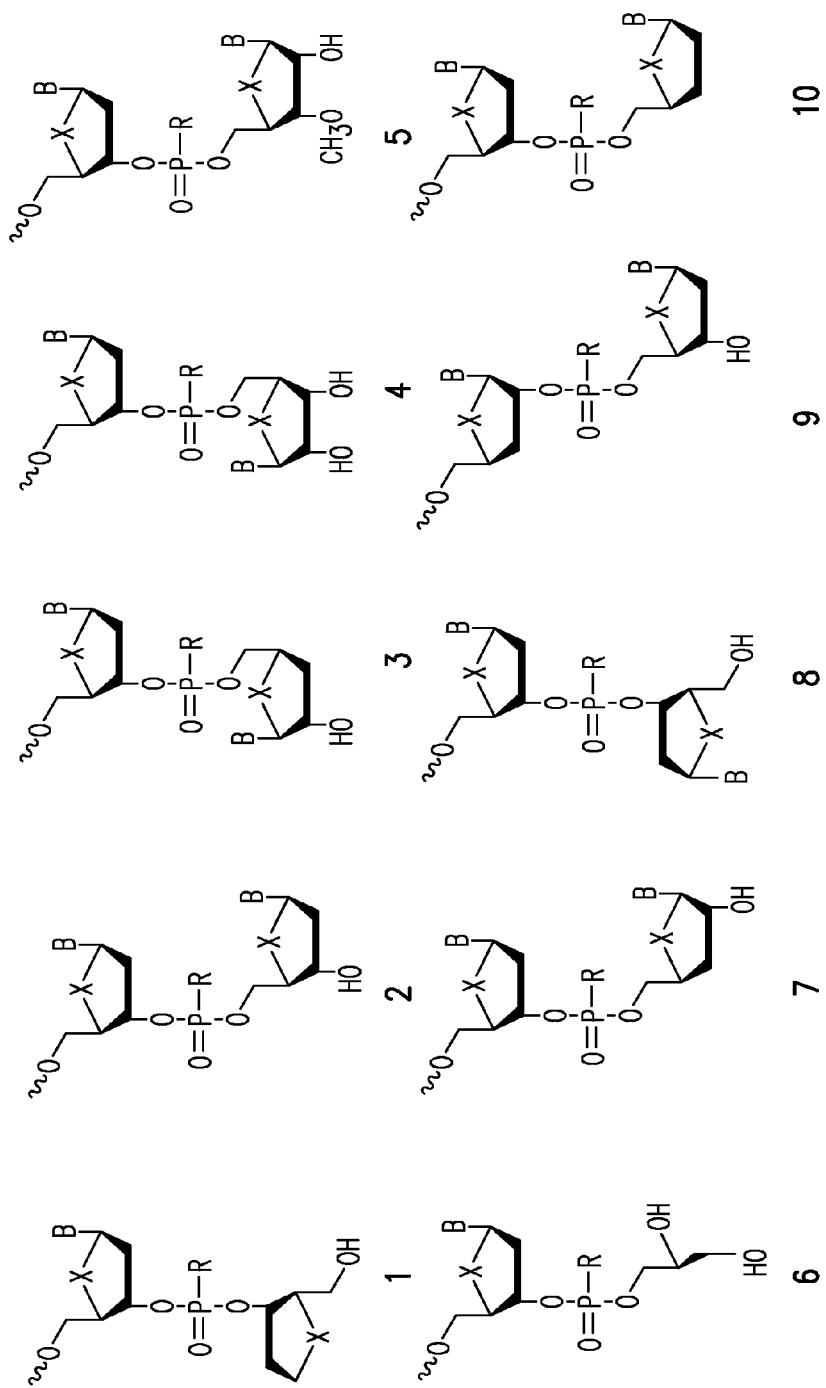

FIG. 5 shows non-limiting examples of different stabilization chemistries (1-10) that can be used, for example, to stabilize the 5' and/or 3'-ends of siNA sequences of the invention, including (1) [3-3']-inverted deoxyribose; (2) deoxyribonucleotide; (3) [5'-3']-3'-deoxyribonucleotide; (4) [5'-3]-ribonucleotide; (5) [5'-3]-3'-O-methyl ribonucleotide; (6) 3'-glyceryl; (7) [3'-5']-3'-deoxyribonucleotide; (8) [3'-3']-deoxyribonucleotide; (9) [5'-2']-deoxyribonucleotide; and (10) [5-3']-dideoxyribonucleotide (when X=0). In addition to modified and unmodified backbone chemistries indicated in the figure, these chemistries can be combined with different sugar and base nucleotide modifications as described herein.

Figure 6:
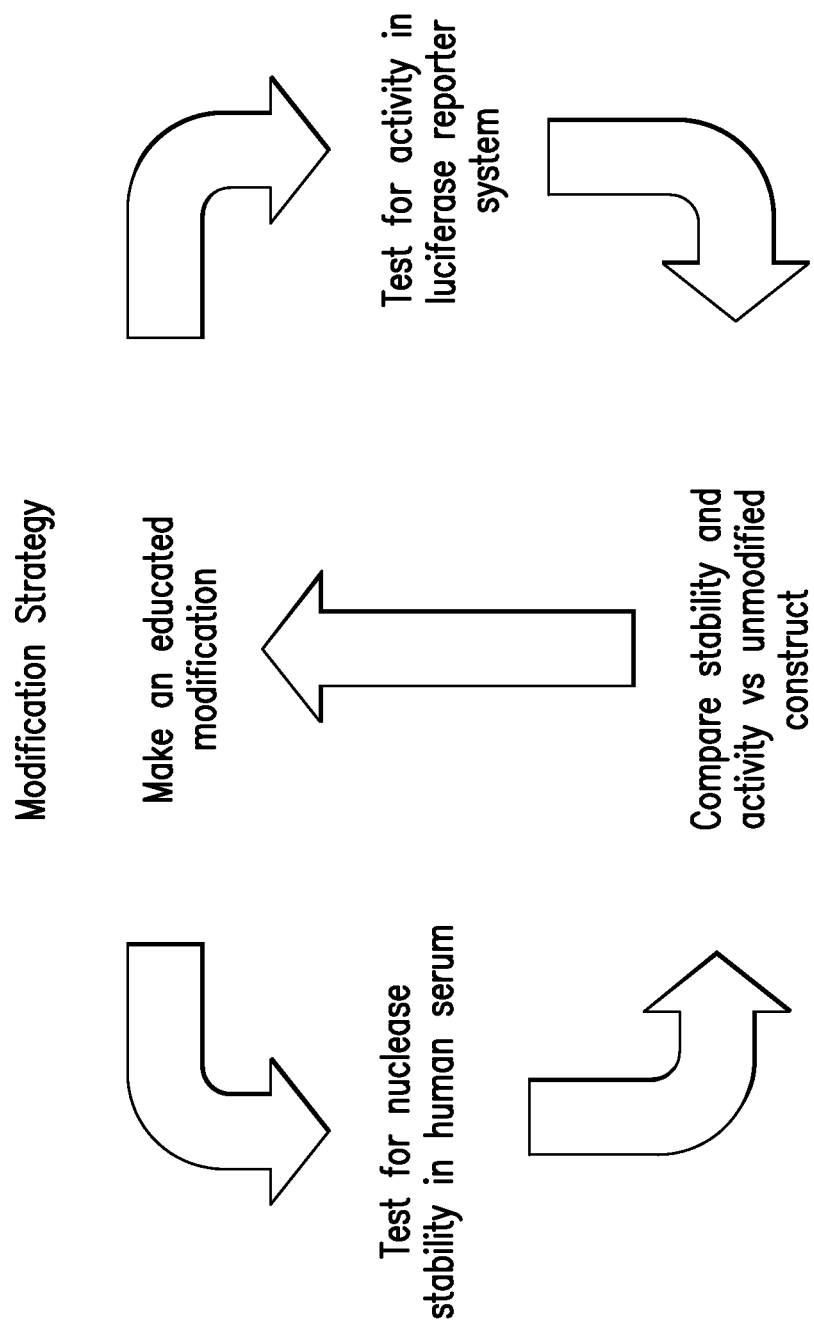

FIG. 6 shows a non-limiting example of a strategy used to identify chemically modified siNA constructs of the invention that are nuclease resistant while preserving the ability to mediate RNAi activity. Chemical modifications are introduced into the siNA construct based on educated design parameters (e.g. introducing 2'-modifications, base modifications, backbone modifications, terminal cap modifications etc). The modified construct is tested in an appropriate system (e.g., human serum for nuclease resistance, shown, or an animal model for PK/delivery parameters). In parallel, the siNA construct is tested for RNAi activity, for example in a cell culture system such as a luciferase reporter assay and/or against endogenous mRNA). Lead siNA constructs are then identified which possess a particular characteristic while maintaining RNAi activity, and can be further modified and assayed once again. This same approach can be used to identify siNA-conjugate molecules with improved pharmacokinetic profiles, delivery, and RNAi activity.

Figure 7:
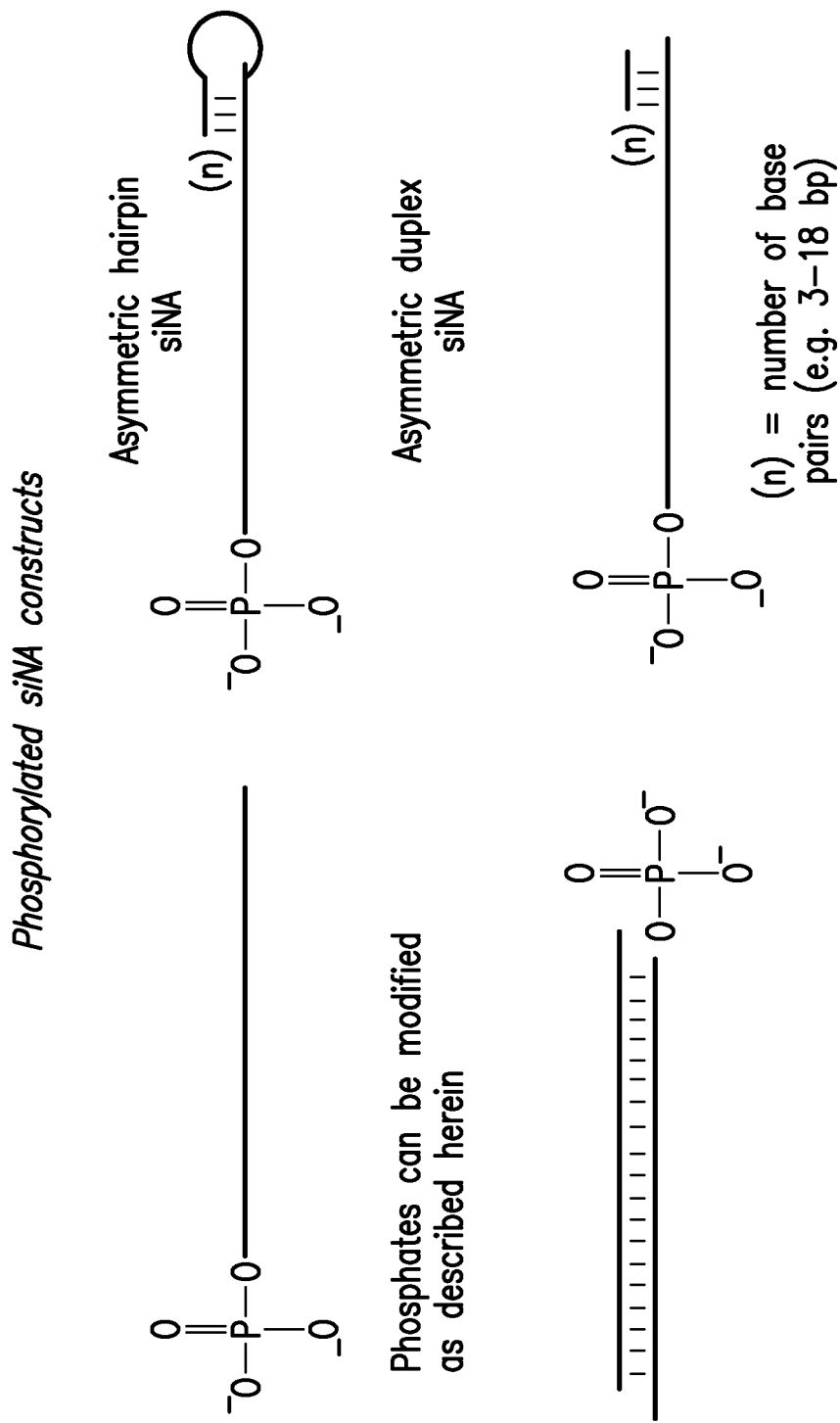

FIG. 7 shows non-limiting examples of phosphorylated siNA molecules of the invention, including linear and duplex constructs and asymmetric derivatives thereof.

Figure 8:
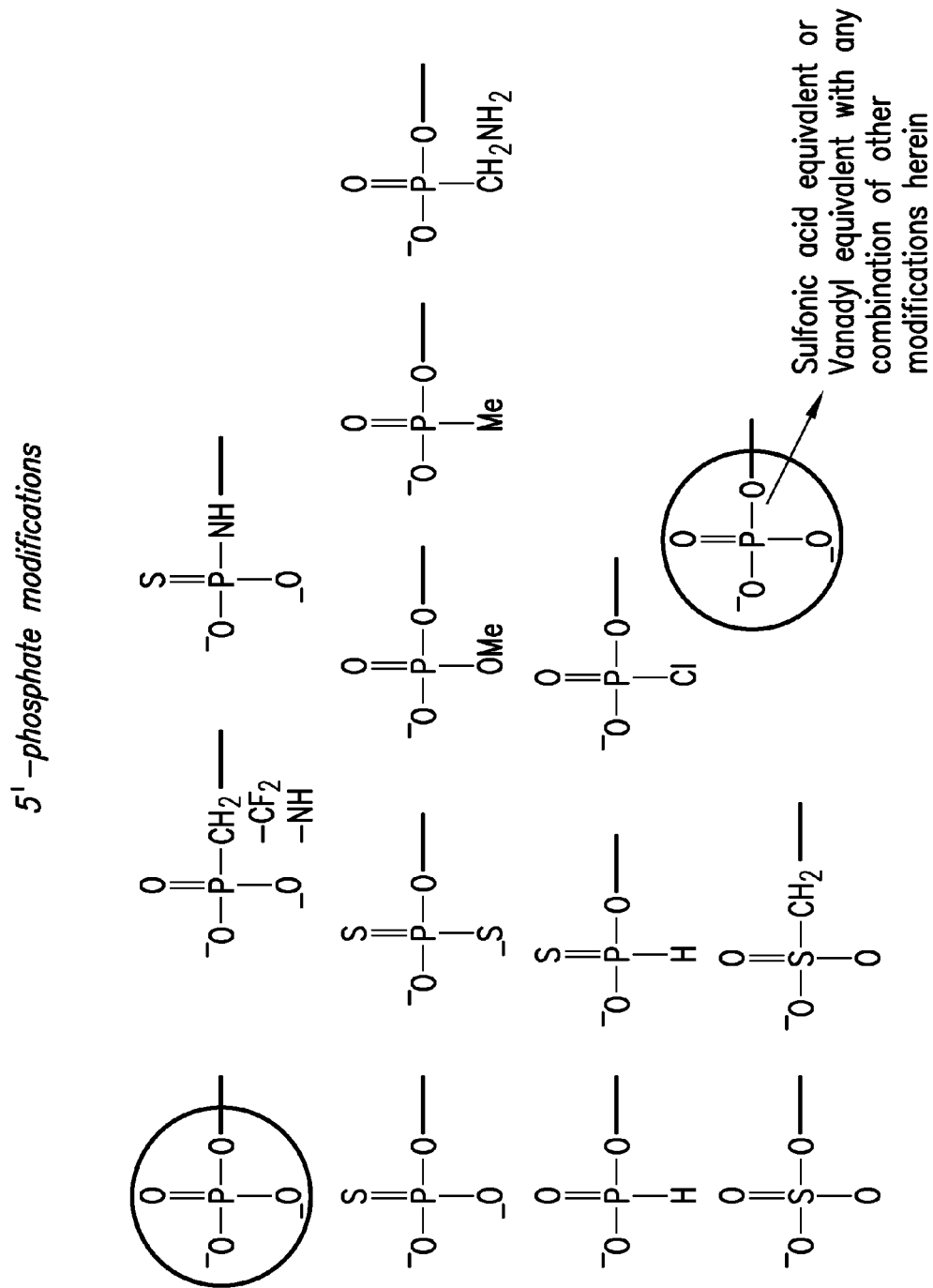

FIG. 8 shows non-limiting examples of chemically modified terminal phosphate groups of the invention.

Figure 9:
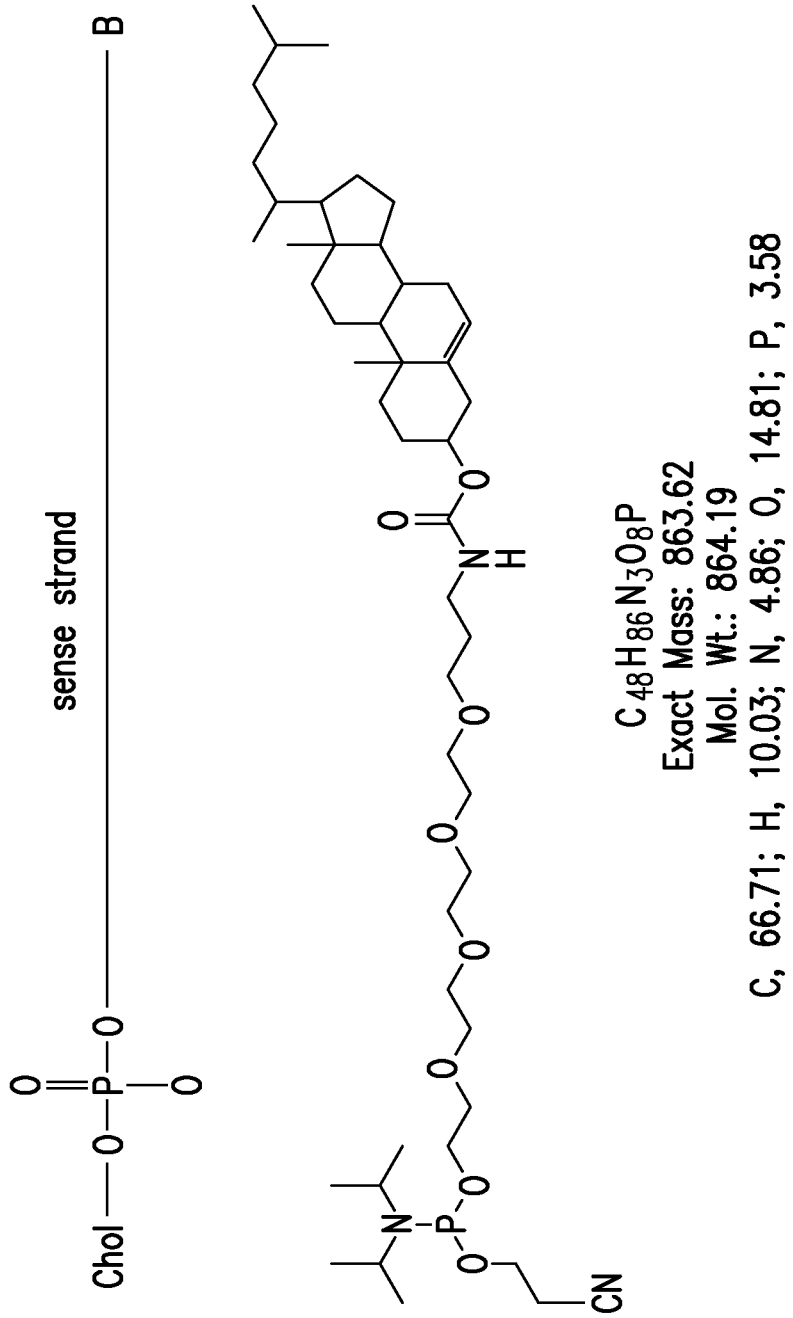

FIG. 9 shows a non-limiting example of a cholesterol linked phosphoramidite that can be used to synthesize cholesterol conjugated siNA molecules of the invention. An example is shown with the cholesterol moiety linked to the 5'-end of the sense strand of an siNA molecule.

Figure 10:
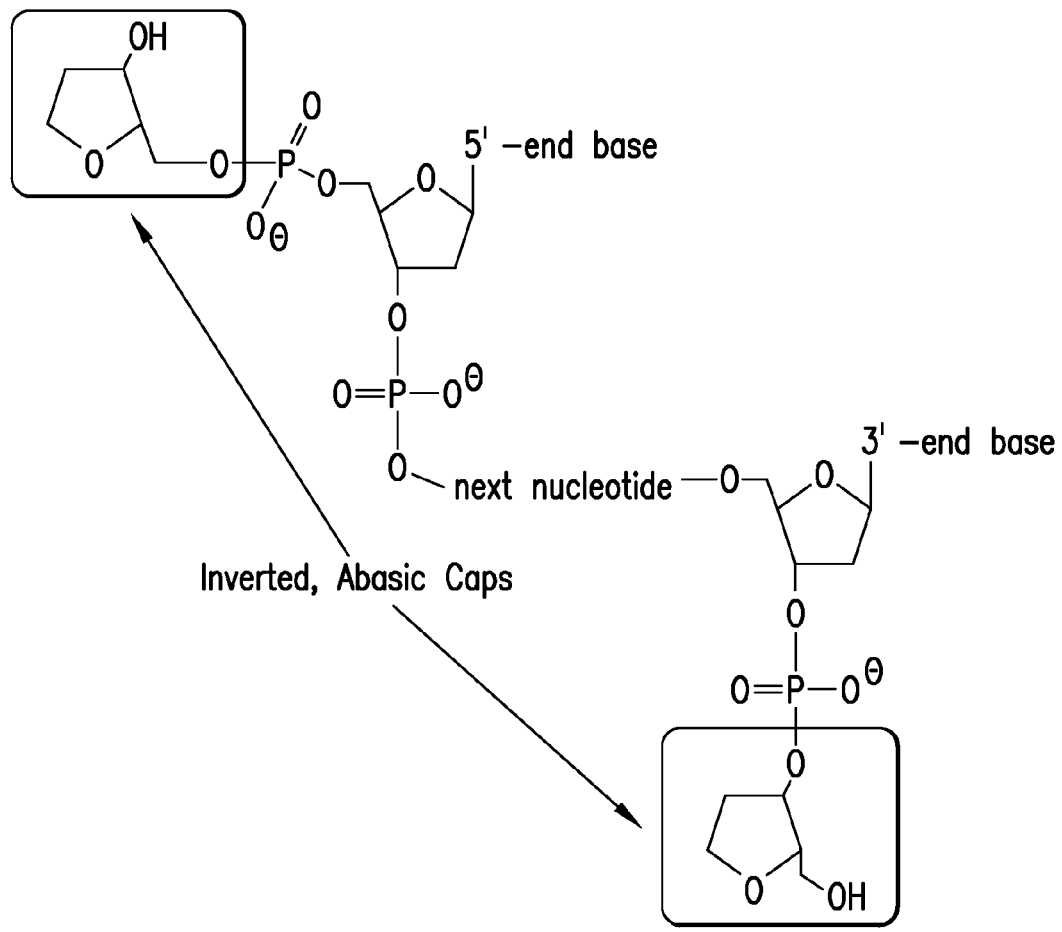

FIG. 10 depicts an embodiment of 5' and 3' inverted abasic cap linked to a nucleic acid strand.

DETAILED DESCRIPTION OF THE INVENTION

A. Terms and Definitions

The following terminology and definitions apply as used in the present application.

The term "abasic" as used herein refers to its meaning as is generally accepted in the art. The term generally refers to sugar moieties lacking a nucleobase or having a hydrogen atom (H) or other non-nucleobase chemical groups in place of a nucleobase at the 1' position of the sugar moiety, see for example Adamic et al., U.S. Pat. No. 5,998,203. In one embodiment, an abasic moiety of the invention is a ribose, deoxyribose, or dideoxyribose sugar.

The term "acyclic nucleotide" as used herein refers to its meaning as is generally accepted in the art. The term generally refers to any nucleotide having an acyclic ribose sugar, for example where any of the ribose carbon/carbon or carbon/oxygen bonds are independently or in combination absent from the nucleotide.

The term "alkyl" as used herein refers to its meaning as is generally accepted in the art. The term generally refers to a saturated or unsaturated hydrocarbons, including straight-chain, branched-chain, alkenyl, alkynyl groups and cyclic groups, but excludes aromatic groups. Notwithstanding the foregoing, alkyl also refers to non-aromatic heterocyclic groups. Preferably, the alkyl group has 1 to 12 carbons. More preferably, it is a lower alkyl of from 1 to 7 carbons, more preferably 1 to 4 carbons. The alkyl group can be substituted or unsubstituted. When substituted, the substituted group(s) is preferably, hydroxyl, halogen, cyano, C1-C4 alkoxy, =O, =S, $NO_2$, SH, $NH_2$, or $NR_1R_2$, where $R_1$ and $R_2$ independently are H or C1-C4 alkyl.

The phrase "agents that interfere with cell cycle checkpoints" refers to compounds that inhibit protein kinases that transduce cell cycle checkpoint signals, thereby sensitizing the cancer cell to DNA damaging agents.

The phrase "agents that interfere with receptor tyrosine kinases (RTKs)" refers to compounds that inhibit RTKs and therefore inhibit mechanisms involved in oncogenesis and tumor progression.

The phrase "androgen receptor modulators" refers to compounds that interfere or inhibit the binding of androgens to the receptor, regardless of mechanism.

The phrase "angiogenesis inhibitors" refers to compounds that inhibit the formation of new blood vessels, regardless of mechanism.

The term "aryl" as used herein refers to its meaning as is generally accepted in the art. The term generally refers to an aromatic group that has at least one ring having a conjugated pi electron system and includes carbocyclic aryl, heterocyclic aryl and biaryl groups, all of which can be optionally substituted. The preferred substituent(s) of aryl groups are halogen, trihalomethyl, hydroxyl, SH, OH, cyano, C1-C4 alkoxy, C1-C4 alkyl, C2-C4 alkenyl, C2-C4 alkynyl, $NH_2$, and $NR_1R_2$ groups, where $R_1$ and $R_2$ independently are H or C1-C4 alkyl.

The term "alkylaryl" as used herein refers to its meaning as is generally accepted in the art. The term generally refers to an alkyl group (as described above) covalently joined to an aryl group (as described above). Carbocyclic aryl groups are groups wherein the ring atoms on the aromatic ring are all carbon atoms. The carbon atoms are optionally substituted. Heterocyclic aryl groups are groups having from 1 to 3 heteroatoms as ring atoms in the aromatic ring and the remainder of the ring atoms are carbon atoms. Suitable heteroatoms include oxygen, sulfur, and nitrogen, and examples of heterocyclic aryl groups having such heteroatoms include furanyl, thienyl, pyridyl, pyrrolyl, N-lower alkyl pyrrolo, pyrimidyl, pyrazinyl, imidazolyl and the like, all optionally substituted. Preferably, the alkyl group is a C1-C4 alkyl group.

The term "amide" as used herein refers to its meaning as is generally accepted in the art. The term generally refers to an —C(O)—NH—R, where R is either alkyl, aryl, alkylaryl or hydrogen.

The phrase "antisense region" as used herein refers to its meaning as is generally accepted in the art. With reference to exemplary nucleic acid molecules of the invention, the term refers to a nucleotide sequence of an siNA molecule having complementarity to a target nucleic acid sequence. In addition, the antisense region of an siNA molecule can optionally comprise a nucleic acid sequence having complementarity to a sense region of the siNA molecule. In one embodiment, the antisense region of the siNA molecule is referred to as the antisense strand or guide strand.

The phrase "asymmetric hairpin" refers to a linear siNA molecule comprising an antisense region, a loop portion that can comprise nucleotides or non-nucleotides, and a sense region that comprises fewer nucleotides than the antisense region to the extent that the sense region has enough complementary nucleotides to base pair with the antisense region and form a duplex with loop. For example, an asymmetric hairpin siNA molecule of the invention can comprise an antisense region having length sufficient to mediate RNAi in a cell or in vitro system (e.g. about 15 to about 30, or about 15, 16, 17, 18, 19, 20, 21, 22, 23, 24, 25, 26, 27, 28, 29, or 30 nucleotides) and a loop region comprising about 4 to about 12 (e.g., about 4, 5, 6, 7, 8, 9, 10, 11, or 12) nucleotides, and a sense region having about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides that are complementary to the antisense region. The asymmetric hairpin siNA molecule can also comprise a 5'-terminal phosphate group that can be chemically modified. The loop portion of the asymmetric hairpin siNA molecule can comprise nucleotides, non-nucleotides, linker molecules, or conjugate molecules as described herein.

The term "biodegradable" as used herein refers to its meaning as is generally accepted in the art. The term generally refers to degradation in a biological system, for example, enzymatic degradation or chemical degradation.

The term "biodegradable linker" as used herein refers to its meaning as is generally accepted in the art. With reference to exemplary nucleic acid molecules of the invention, the term refers to a linker molecule that is designed to connect one molecule to another molecule, and which is susceptible to degradation in a biological system. The linker can be a nucleic acid or non-nucleic acid based linker. For example, a biodegradable linker can be used to attach a ligand or biologically active molecule to an siNA molecule of the invention. Alternately, a biodegradable linker can be used to connect the sense and antisense strands of an siNA molecule of the invention. The biodegradable linker is designed such that its stability can be modulated for a particular purpose, such as delivery to a particular tissue or cell type. The stability of a nucleic acid-based biodegradable linker molecule can be modulated by using various chemistries, for example combinations of ribonucleotides, deoxyribonucleotides, and chemically modified nucleotides, such as 2'-O-methyl, 2'-fluoro, 2'-amino, 2'-O-amino, 2'-C-allyl, 2'-O-allyl, and other 2'-modified or base modified nucleotides. The biodegradable nucleic acid linker molecule can be a dimer, trimer, tetramer or longer nucleic acid molecule, for example, an oligonucleotide of about 2, 3, 4, 5, 6, 7, 8, 9, 10, 11, 12, 13, 14, 15, 16, 17, 18, 19, or 20 nucleotides in length, or can comprise a single nucleotide with a phosphorus-based linkage, for example, a phosphoramidate or phosphodiester linkage. The biodegradable nucleic acid linker molecule can also comprise nucleic acid backbone, nucleic acid sugar, or nucleic acid base modifications.

The phrase "biologically active molecule" as used herein refers to its meaning as is generally accepted in the art. With reference to exemplary nucleic acid molecules of the invention, the term refers to compounds or molecules that are capable of eliciting or modifying a biological response in a system and/or are capable of modulating the pharmacokinetics and/or pharmacodynamics of other biologically active molecules. Examples of biologically active molecules, include siNA molecules alone or in combination with other molecules including, but not limited to therapeutically active molecules such as antibodies, cholesterol, hormones, antivirals, peptides, proteins, chemotherapeutics, small molecules, vitamins, co-factors, nucleosides, nucleotides, oligonucleotides, enzymatic nucleic acids, antisense nucleic acids, triplex forming oligonucleotides, polyamines, polyamides, polyethylene glycol, other polyethers, 2-5A chimeras, siNA, dsRNA, allozymes, aptamers, decoys and analogs thereof.

The phrase "biological system" as used herein refers to its meaning as is generally accepted in the art. The term generally refers to material, in a purified or unpurified form, from biological sources including, but not limited to, human or animal, wherein the system comprises the components required for RNAi activity. Thus, the phrase includes, for example, a cell, tissue, subject, or organism, or extract thereof. The term also includes reconstituted material from a biological source.

The phrase "blunt end" as used herein refers to its meaning as is generally accepted in the art. With reference to exemplary nucleic acid molecules of the invention, the term refers to termini of a double-stranded siNA molecule having no overhanging nucleotides. For example, the two strands of a double-stranded siNA molecule having blunt ends align with each other with matched base-pairs without overhanging nucleotides at the termini. A siNA duplex molecule of the invention can comprise blunt ends at one or both termini of the duplex, such as termini located at the 5'-end of the antisense strand, the 5'-end of the sense strand, or both termini of the duplex.

The term "cap" also referred to herein as "terminal cap," as used herein refers to its meaning as is generally accepted in the art. With reference to exemplary nucleic acid molecules of the invention, the term refers to a moiety, which can be a chemically modified nucleotide or non-nucleotide that can be incorporated at one or more termini of one or more nucleic acid molecules of the invention. These terminal modifications protect the nucleic acid molecule from exonuclease degradation, and can help in delivery and/or localization within a cell. The cap can be present at the 5'-terminus (5'-cap) or at the 3'-terminal (3'-cap) or can be present on both termini of any nucleic acid molecule of the invention. A cap can be present at the 5'-end, 3-end and/or 5' and 3'-ends of the sense strand of a nucleic acid molecule of the invention. Additionally, a cap can optionally be present at the 3'-end of the antisense strand of a nucleic acid molecule of the invention. In non-limiting examples, the 5'-cap includes, but is not limited to, LNA; glyceryl; inverted deoxy abasic residue (moiety); 4',5'-methylene nucleotide; 1-(beta-D-erythrofuranosyl) nucleotide, 4'-thio nucleotide; carbocyclic nucleotide; 1,5-anhydrohexitol nucleotide; L-nucleotides; alpha-nucleotides; modified base nucleotide; phosphorodithioate linkage; threo-pentofuranosyl nucleotide; acyclic 3',4'-seco nucleotide; acyclic 3,4-dihydroxybutyl nucleotide; acyclic 3,5-dihydroxypentyl nucleotide; 3'-3'-inverted nucleotide moiety; 3'-3'-inverted abasic moiety; 3'-2'-inverted nucleotide moiety; 3'-2'-inverted abasic moiety; 1,4-butanediol phosphate; 3'-phosphoramidate; hexylphosphate; aminohexyl phosphate; 3'-phosphate; 3'-phosphorothioate; phosphorodithioate; or bridging or non-bridging methylphosphonate moiety. Non-limiting examples of the 3'-cap include, but are not limited to, LNA; glyceryl; inverted deoxy abasic residue (moiety); 4',5'-methylene nucleotide; 1-(beta-D-erythrofuranosyl) nucleotide; 4'-thio nucleotide; carbocyclic nucleotide; 5'-amino-alkyl phosphate; 1,3-diamino-2-propyl phosphate; 3-aminopropyl phosphate; 6-aminohexyl phosphate; 1,2-aminododecyl phosphate; hydroxypropyl phosphate; 1,5-anhydrohexitol nucleotide; L-nucleotide; alpha-nucleotide; modified base nucleotide; phosphorodithioate; threo-pentofuranosyl nucleotide; acyclic 3',4'-seco nucleotide; 3,4-dihydroxybutyl nucleotide; 3,5-dihydroxypentyl nucleotide, 5'-5'-inverted nucleotide moiety; 5'-5'-inverted abasic moiety; 5'-phosphoramidate; 5'-phosphorothioate; 1,4-butanediol phosphate; 5'-amino; bridging and/or non-bridging 5'-phosphoramidate; phosphorothioate and/or phosphorodithioate; bridging or non bridging methylphosphonate; and 5'-mercapto moieties (for more details see Beaucage and Iyer, 1993, *Tetrahedron* 49, 1925; incorporated by reference herein). FIG. 5 shows some non-limiting examples of various caps.

The term "cell" as used herein refers to its meaning as is generally accepted in the art. With reference to exemplary nucleic acid molecules of the invention, the term is used in its usual biological sense, and does not refer to an entire multicellular organism, e.g., specifically does not refer to a human being. The cell can be present in an organism, e.g., birds, plants and mammals, such as humans, cows, sheep, apes, monkeys, swine, dogs, and cats. The cell can be prokaryotic (e.g., bacterial cell) or eukaryotic (e.g., mammalian or plant cell). The cell can be of somatic or germ line origin, totipotent or pluripotent, dividing or non-dividing. The cell can also be derived from or can comprise a gamete or embryo, a stem cell, or a fully differentiated cell.

The phrase "chemical modification" as used herein refers to its meaning as is generally accepted in the art. With reference to exemplary nucleic acid molecules of the invention, the term refers to any modification of the chemical structure of the nucleotides that differs from nucleotides of native siRNA or RNA in general. The term "chemical modification" encompasses the addition, substitution, or modification of native siRNA or RNA at the sugar, base, or internucleotide linkage, as described herein or as is otherwise known in the art. In certain embodiments, the term "chemical modification" can refer to certain forms of RNA that are naturally occurring in certain biological systems, for example 2'-O-methyl modifications or inosine modifications.

The term "CTNNB1" refers to catenin (cadherin-associated protein), beta 1 which is gene that encodes CTNNB1 proteins, CTNNB1 peptides, CTNNB1 polypeptides, CTNNB1 regulatory polynucleotides (e.g., CTNNB1 miRNAs and siNAs), mutant CTNNB1 genes, and splice variants of a CTNNB1 genes, as well as other genes involved in CTNNB1 pathways of gene expression and/or activity. Thus, each of the embodiments described herein with reference to the term "CTNNB1" are applicable to all of the protein, peptide, polypeptide, and/or polynucleotide molecules covered by the term "CTNNB1", as that term is defined herein. Comprehensively, such gene targets are also referred to herein generally as "target" sequences (including the target sequences listed in Table 1a).

The term "complementarity" or "complementary" as used herein refers to its meaning as is generally accepted in the art. With reference to exemplary nucleic acid molecules of the invention, the terms generally refer to the formation or existence of hydrogen bond(s) between one nucleic acid sequence and another nucleic acid sequence by either traditional Watson-Crick or other non-traditional types of bonding as described herein. In reference to the nucleic molecules of the present invention, the binding free energy for a nucleic acid molecule with its complementary sequence is sufficient to allow the relevant function of the nucleic acid to proceed, e.g., RNAi activity. Determination of binding free energies for nucleic acid molecules is well known in the art (see, e.g., Turner et al., 1987, *CSH Symp. Quant. Biol*. LII pp. 123-133; Frier et al., 1986, *Proc. Nat. Acad. Sci*. USA 83:9373-9377; Turner et al., 1987, *J. Am. Chem. Soc*. 109:3783-3785). Perfect complementary means that all the contiguous residues of a nucleic acid sequence will hydrogen bond with the same number of contiguous residues in a second nucleic acid sequence. Partial complementarity can include various mismatches or non-based paired nucleotides (e.g., 1, 2, 3, 4, 5, 6, 7, 8, 9, 10 or more mismatches, non-nucleotide linkers, or non-based paired nucleotides) within the nucleic acid molecule, which can result in bulges, loops, or overhangs that result between the sense strand or sense region and the antisense strand or antisense region of the nucleic acid molecule or between the antisense strand or antisense region of the nucleic acid molecule and a corresponding target nucleic acid molecule. Such partial complementarity can be represented by a % complementarity that is determined by the number of non-base paired nucleotides, i.e., about 50%, 60%, 70%, 80%, 90% etc. depending on the total number of nucleotides involved. Such partial complementarity is permitted to the extent that the nucleic acid molecule (e.g., siNA) maintains its function, for example the ability to mediate sequence specific RNAi.

The terms "composition" or "formulation" as used herein refer to their generally accepted meaning in the art. These terms generally refer to a composition or formulation, such as in a pharmaceutically acceptable carrier or diluent, in a form suitable for administration, e.g., systemic or local administration, into a cell or subject, including, for example, a human. Suitable forms, in part, depend upon the use or the route of entry, for example oral, transdermal, inhalation, or by injection. Such forms should not prevent the composition or formulation from reaching a target cell (i.e., a cell to which the negatively charged nucleic acid is desirable for delivery). For example, compositions injected into the blood stream should be soluble. Other factors are known in the art, and include considerations such as toxicity and forms that prevent the composition or formulation from exerting its effect. As used herein, pharmaceutical formulations include formulations for human and veterinary use. Non-limiting examples of agents suitable for formulation with the nucleic acid molecules of the instant invention include: Lipid Nanoparticles (see for example Semple et al., 2010, *Nat Biotechnol., February;* 28(2):172-6.); P-glycoprotein inhibitors (such as Pluronic P85); biodegradable polymers, such as poly(DL-lactide-coglycolide) microspheres for sustained release delivery (Emerich, D F et al, 1999, *Cell Transplant,* 8, 47-58); and loaded nanoparticles, such as those made of polybutylcyanoacrylate. Other non-limiting examples of delivery strategies for the nucleic acid molecules of the instant invention include material described in Boado et al., 1998, *J. Pharm. Sci.,* 87, 1308-1315; Tyler et al., 1999, *FEBS Lett.,* 421, 280-284; Pardridge et al., 1995, *PNAS USA.,* 92, 5592-5596; Boado, 1995, *Adv. Drug Delivery Rev.,* 15, 73-107; Aldrian-Herrada et al., 1998, *Nucleic Acids Res.,* 26, 4910-4916; and Tyler et al., 1999, *PNAS USA.,* 96, 7053-7058. A "pharmaceutically acceptable composition" or "pharmaceutically acceptable formulation" can refer to a composition or formulation that allows for the effective distribution of the nucleic acid molecules of the instant invention to the physical location most suitable for their desired activity.

The phrase "cytotoxic/cytostatic agents" refer to compounds that cause cell death or inhibit cell proliferation primarily by interfering directly with the cell's functioning or inhibit or interfere with cell mytosis, including alkylating agents, tumor necrosis factors, intercalators, hypoxia activatable compounds, microtubule inhibitors/microtubule-stabilizing agents, inhibitors of mitotic kinesins, inhibitors of histone deacetylase, inhibitors of kinases involved in mitotic progression, antimetabolites; biological response modifiers; hormonal/anti-hormonal therapeutic agents, hematopoietic growth factors, monoclonal antibody targeted therapeutic agents, topoisomerase inhibitors, proteasome inhibitors and ubiquitin ligase inhibitors.

The phrase "estrogen receptor modulators" refers to compounds that interfere with or inhibit the binding of estrogen to the receptor, regardless of mechanism.

The term "gene" or "target gene" as used herein refers to their meaning as is generally accepted in the art. The terms generally refer a nucleic acid (e.g., DNA or RNA) sequence that comprises partial length or entire length coding sequences necessary for the production of a polypeptide. The target gene can also include the UTR or non-coding region of the nucleic acid sequence. A gene or target gene can also encode a functional RNA (fRNA) or non-coding RNA (ncRNA), such as small temporal RNA (stRNA), micro RNA (miRNA), small nuclear RNA (snRNA), short interfering RNA (siRNA), small nucleolar RNA (snRNA), ribosomal RNA (rRNA), transfer RNA (tRNA) and precursor RNAs thereof. Such non-coding RNAs can serve as target nucleic acid molecules for siNA mediated RNA interference in modulating the activity of fRNA or ncRNA involved in functional or regulatory cellular processes. Aberrant fRNA or ncRNA activity leading to disease can therefore be modulated by siNA molecules of the invention. siNA molecules targeting fRNA and ncRNA can also be used to manipulate or alter the genotype or phenotype of a subject, organism or cell, by intervening in cellular processes such as genetic imprinting, transcription, translation, or nucleic acid processing (e.g., transamination, methylation etc.). The target gene can be a gene derived from a cell, an endogenous gene, a transgene, or exogenous genes such as genes of a pathogen, for example a virus, which is present in the cell after infection thereof. The cell containing the target gene can be derived from or contained in any organism, for example a plant, animal, protozoan, virus, bacterium, or fungus. Non-limiting examples of plants include monocots, dicots, or gymnosperms. Non-limiting examples of animals include vertebrates or invertebrates. Non-limiting examples of fungi include molds or yeasts. For a review, see for example Snyder and Gerstein, 2003, *Science,* 300, 258-260.

The phrase "HMG-CoA reductase inhibitors" refers to inhibitors of 3-hydroxy-3-methylglutaryl-CoA reductase. The term HMG-CoA reductase inhibitor as used herein includes all pharmaceutically acceptable lactone and open-acid forms (i.e., where the lactone ring is opened to form the free acid) as well as salt and ester forms of compounds that have HMG-CoA reductase inhibitory activity, and therefore the use of such salts, esters, open-acid and lactone forms is included within the scope of this invention.

The phrase "homologous sequence" as used herein refers to its meaning as is generally accepted in the art. The term generally refers a nucleotide sequence that is shared by one or more polynucleotide sequences, such as genes, gene transcripts and/or non-coding polynucleotides. For example, a homologous sequence can be a nucleotide sequence that is shared by two or more genes encoding related but different proteins, such as different members of a gene family, different protein epitopes, different protein isoforms or completely divergent genes. A homologous sequence can be a nucleotide sequence that is shared by two or more non-coding polynucleotides, such as noncoding DNA or RNA, regulatory sequences, introns, and sites of transcriptional control or regulation. Homologous sequences can also include sequence regions shared by more than one polynucleotide sequence. Homology does not need to be perfect identity (100%), as partially homologous sequences are also contemplated by and within the scope of the instant invention (e.g., at least 95%, 94%, 93%, 92%, 91%, 90%, 89%, 88%, 87%, 86%, 85%, 84%, 83%, 82%, 81%, 80% etc.). Percent homology is the number of matching nucleotides between two sequences divided by the total length being compared, multiplied by 100.

The phrase "improved RNAi activity" refers to an increase in RNAi activity measured in vitro and/or in vivo, where the RNAi activity is a reflection of both the ability of the siNA to mediate RNAi and the stability of the siNAs of the invention. In this invention, the product of these activities can be increased in vitro and/or in vivo compared to an all RNA siNA or an siNA containing a plurality of ribonucleotides. In some cases, the activity or stability of the siNA molecule can be decreased (i.e., less than ten-fold), but the overall activity of the siNA molecule is enhanced in vitro and/or in vivo.

The terms "inhibit," "down-regulate," or "reduce" as used herein refers to its meaning as is generally accepted in the art. With reference to exemplary nucleic acid molecules of the invention, the term generally refers the reduction in the expression of the gene, or level of RNA molecules or equivalent RNA molecules encoding one or more proteins or protein subunits, or activity of one or more proteins or protein subunits, below that observed in the absence of the nucleic acid molecules (e.g., siNA) of the invention. Down-regulation can also be associated with post-transcriptional silencing, such as, RNAi mediated cleavage or by alteration in DNA methylation patterns or DNA chromatin structure Inhibition, down-regulation or reduction with an siNA molecule can be in reference to an inactive molecule, an attenuated molecule, an siNA molecule with a scrambled sequence, or an siNA molecule with mismatches or alternatively, it can be in reference to the system in the absence of the nucleic acid.

The phrase "inhibitors of cell proliferation and survival signaling pathway" refers to pharmaceutical agents that inhibit cell surface receptors and signal transduction cascades downstream of those surface receptors.

The term "integrin blockers" refers to compounds which selectively antagonize, inhibit or counteract binding of a physiological ligand to the $\alpha_\nu\beta_3$ integrin, to compounds which selectively antagonize, inhibit or counteract binding of a physiological ligand to the $\alpha_\nu\beta_5$ integrin, to compounds which antagonize, inhibit or counteract binding of a physiological ligand to both the $\alpha_\nu\beta_3$ integrin and the $\alpha_\nu\beta_5$ integrin, and to compounds which antagonize, inhibit or counteract the activity of the particular integrin(s) expressed on capillary endothelial cells. The term also refers to antagonists of the $\alpha_\nu\beta_6$, $\alpha_\nu\beta_8$, $\alpha_1\beta_1$, $\alpha_2\beta_1$, $\alpha_5\beta_1$, $\alpha_6\beta_1$ and $\alpha_6\beta_4$ integrins. The term also refers to antagonists of any combination of $\alpha_\nu\beta_3$, $\alpha_\nu\beta_5$, $\alpha_\nu\beta_6$, $\alpha_\nu\beta_8$, $\alpha_1\beta_1$, $\alpha_2\beta_1$, $\alpha_5\beta_1$, $\alpha_6\beta_1$, and $\alpha_6\beta_4$ integrins.

The terms "intermittent" or "intermittently" as used herein refers to its meaning as is generally accepted in the art. The term generally refers to periodic stopping and starting at either regular or irregular intervals.

The terms "internucleoside linkage" or "internucleoside linker" or "internucleotide linkage" or "internucleotide linker" are used herein interchangeably and refer to any linker or linkage between two nucleoside units, as is known in the art, including, for example, but not limitation, phosphate, analogs of phosphate, phosphonate, guanidium, hydroxylamine, hydroxylhydrazinyl, amide, carbamate, alkyl, and substituted alkyl linkages. The internucleoside linkages constitute the backbone of a nucleic acid molecule.

The terms "mammalian" or "mammal" as used herein refers to its meaning as is generally accepted in the art. The term generally refers to any warm blooded vertebrate species, such as a human, mouse, rat, dog, cat, hamster, guinea pig, rabbit, livestock, and the like.

The phrase "metered dose inhaler" or MDI refers to a unit comprising a can, a secured cap covering the can and a formulation metering valve situated in the cap. MDI systems includes a suitable channeling device. Suitable channeling devices comprise for example, a valve actuator and a cylindrical or cone-like passage through which medicament can be delivered from the filled canister via the metering valve to the nose or mouth of a patient such as a mouthpiece actuator.

The term "microRNA" or "miRNA" as used herein refers to its meaning as is generally accepted in the art. The term generally refers a small double-stranded RNA that regulates the expression of target messenger RNAs either by mRNA cleavage, translational repression/inhibition or heterochromatic silencing (see for example Ambros, 2004, Nature, 431, 350-355; Bartel, 2004, Cell, 116, 281-297; Cullen, 2004, Virus Research., 102, 3-9; He et al., 2004, Nat. Rev. Genet., 5, 522-531; Ying et al., 2004, Gene, 342, 25-28; and Sethupathy et al., 2006, RNA, 12:192-197).

The term "modulate" as used herein refers to its meaning as is generally accepted in the art. With reference to exemplary nucleic acid molecules of the invention, the term refers to when the expression of a gene, or level of one or more RNA molecules (coding or non-coding), or activity of one or more RNA molecules or proteins or protein subunits, is up-regulated or down-regulated, such that expression, level, or activity is greater than or less than that observed in the absence of the molecule that effects modulation. For example, the term "modulate" in some embodiments can refer to inhibition and in other embodiments can refer to potentiation or up-regulation, e.g., of gene expression.

The phrase "modified nucleotide" as used herein refers to its meaning as is generally accepted in the art. The term generally refers a nucleotide, which contains a modification in the chemical structure of the base, sugar and/or phosphate of the unmodified (or natural) nucleotide as is generally known in the art. Non-limiting examples of modified nucleotides are described herein and in U.S. application Ser. No. 12/064,014.

The phrase "NSAIDs that are selective COX-2 inhibitors" for purposes herein, refers to NSAIDs, which possess a specificity for inhibiting COX-2 over COX-1 of at least 100 fold as measured by the ratio of $IC_{50}$ for COX-2 over $IC_{50}$ for COX-1 evaluated by cell or microsomal assays.

The phrase "non-base paired" refers to nucleotides that are not base paired between the sense strand or sense region and the antisense strand or antisense region of an double-stranded siNA molecule; and can include for example, but not limitation, mismatches, overhangs, single stranded loops, etc.

The term "non-nucleotide" refers to any group or compound which can be incorporated into a nucleic acid chain in the place of one or more nucleotide units, such as for example but not limitation abasic moieties or alkyl chains. The group or compound is "abasic" in that it does not contain a commonly recognized nucleotide base, such as adenosine, guanine, cytosine, uracil or thymine and therefore lacks a nucleobase at the 1'-position.

The term "nucleotide" is used as is generally recognized in the art. Nucleotides generally comprise a nucleobase, a sugar, and an internucleoside linkage, e.g., a phosphate. The base can be a natural bases (standard), modified bases, or a base analog, as are well known in the art. Such bases are generally located at the 1' position of a nucleotide sugar moiety. Additionally, the nucleotides can be unmodified or modified at the sugar, internucleoside linkage, and/or base moiety, (also referred to interchangeably as nucleotide analogs, modified nucleotides, non-natural nucleotides, non-standard nucleotides and others; see, for example, U.S. application Ser. No. 12/064,014.

The term "overhang" as used herein refers to its meaning as is generally accepted in the art. With reference to exemplary double stranded nucleic acid molecules, the term generally refers to the terminal portion of a nucleotide sequence that is not base paired between the two strands of a double-stranded nucleic acid molecule (see for example, FIG. 4). Overhangs, when present, are typically at the 3'-end of one or both strands in a siNA duplex.

The term "parenteral" as used herein refers to its meaning as is generally accepted in the art. The term generally refers methods or techniques of administering a molecule, drug, agent, or compound in a manner other than through the digestive tract, and includes epicutaneous, subcutaneous, intravascular (e.g., intravenous), intramuscular, or intrathecal injection or infusion techniques and the like.

The phrase "pathway target" refers to any target involved in pathways of gene expression or activity. For example, any given target can have related pathway targets that can include upstream, downstream, or modifier genes in a biologic pathway. These pathway target genes can provide additive or synergistic effects in the treatment of diseases, conditions, and traits herein.

The term "phosphorothioate" refers to an internucleotide phosphate linkage comprising one or more sulfur atoms in place of an oxygen atom. Hence, the term phosphorothioate refers to both phosphorothioate and phosphorodithioate internucleotide linkages.

"Prenyl-protein transferase inhibitor" refers to a compound that inhibits any one or any combination of the prenyl-protein transferase enzymes, including farnesyl-protein transferase (FPTase), geranylgeranyl-protein transferase type I (GGPTase-I), and geranylgeranyl-protein transferase type-II (GGPTase-II, also called Rab GGPTase).

The phrase "retinoid receptor modulators" refers to compounds that interfere or inhibit the binding of retinoids to the receptor, regardless of mechanism.

The term "ribonucleotide" as used herein refers to its meaning as is generally accepted in the art. The term generally refers to a nucleotide with a hydroxyl group at the 2' position of a β-D-ribofuranose moiety.

The term "RNA" as used herein refers to its generally accepted meaning in the art. Generally, the term RNA refers to a molecule comprising at least one ribofuranoside moiety. The term can include double-stranded RNA, single-stranded RNA, isolated RNA such as partially purified RNA, essentially pure RNA, synthetic RNA, recombinantly produced RNA, as well as altered RNA that differs from naturally occurring RNA by the addition, deletion, substitution and/or alteration of one or more nucleotides. Such alterations can include addition of non-nucleotide material, such as to the end(s) of the siNA or internally, for example at one or more nucleotides of the RNA. Nucleotides in the RNA molecules of the instant invention can also comprise non-standard nucleotides, such as non-naturally occurring nucleotides or chemically synthesized nucleotides or deoxynucleotides. These altered RNAs can be referred to as analogs or analogs of naturally-occurring RNA.

The phrase "RNA interference" or term "RNAi" refer to the biological process of inhibiting or down regulating gene expression in a cell, as is generally known in the art, and which is mediated by short interfering nucleic acid molecules, see for example Zamore and Haley, 2005, *Science*, 309, 1519-1524; Vaughn and Martienssen, 2005, *Science*, 309, 1525-1526; Zamore et al., 2000, *Cell*, 101, 25-33; Bass, 2001, *Nature*, 411, 428-429; Elbashir et al., 2001, *Nature*, 411, 494-498; and Kreutzer et al., International PCT Publication No. WO 00/44895; Zernicka-Goetz et al., International PCT Publication No. WO 01/36646; Fire, International PCT Publication No. WO 99/32619; Plaetinck et al., International PCT Publication No. WO 00/01846; Mello and Fire, International PCT Publication No. WO 01/29058; Deschamps-Depaillette, International PCT Publication No. WO 99/07409; and Li et al., International PCT Publication No. WO 00/44914; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237; Hutvagner and Zamore, 2002, *Science*, 297, 2056-60; McManus et al., 2002, *RNA*, 8, 842-850; Reinhart et al., 2002, *Gene & Dev.*, 16, 1616-1626; and Reinhart & Bartel, 2002, *Science*, 297, 1831). Additionally, the term RNAi is meant to be equivalent to other terms used to describe sequence specific RNA interference, such as post transcriptional gene silencing, translational inhibition, transcriptional inhibition, or epigenetics. For example, siNA molecules of the invention can be used to epigenetically silence genes at either the post-transcriptional level or the pre-transcriptional level. In a non-limiting example, epigenetic modulation of gene expression by siNA molecules of the invention can result from siNA mediated modification of chromatin structure or methylation patterns to alter gene expression (see, for example, Verdel et al., 2004, *Science*, 303, 672-676; Pal-Bhadra et al., 2004, *Science*, 303, 669-672; Allshire, 2002, *Science*, 297, 1818-1819; Volpe et al., 2002, *Science*, 297, 1833-1837; Jenuwein, 2002, *Science*, 297, 2215-2218; and Hall et al., 2002, *Science*, 297, 2232-2237). In another non-limiting example, modulation of gene expression by siNA molecules of the invention can result from siNA mediated cleavage of RNA (either coding or non-coding RNA) via RISC, or via translational inhibition, as is known in the art or modulation can result from transcriptional inhibition (see for example Janowski et al., 2005, *Nature Chemical Biology*, 1, 216-222).

The phrase "RNAi inhibitor" refers to any molecule that can down regulate, reduce or inhibit RNA interference function or activity in a cell or organism. An RNAi inhibitor can down regulate, reduce or inhibit RNAi (e.g., RNAi mediated cleavage of a target polynucleotide, translational inhibition, or transcriptional silencing) by interaction with or interfering with the function of any component of the RNAi pathway, including protein components such as RISC, or nucleic acid components such as miRNAs or siRNAs. A RNAi inhibitor can be an siNA molecule, an antisense molecule, an aptamer, or a small molecule that interacts with or interferes with the function of RISC, a miRNA, or an siRNA or any other component of the RNAi pathway in a cell or organism. By inhibiting RNAi (e.g., RNAi mediated cleavage of a target polynucleotide, translational inhibition, or transcriptional silencing), a RNAi inhibitor of the invention can be used to modulate (e.g., up-regulate or down regulate) the expression of a target gene.

The phrase "sense region" as used herein refers to its meaning as is generally accepted in the art. With reference to exemplary nucleic acid molecules of the invention, the term refers to a nucleotide sequence of an siNA molecule having complementarity to an antisense region of the siNA molecule. In addition, the sense region of an siNA molecule can comprise a nucleic acid sequence having homology or sequence identity with a target nucleic acid sequence. In one embodiment, the sense region of the siNA molecule is also referred to as the sense strand or passenger strand.

The phrases "short interfering nucleic acid", "siNA", "short interfering RNA", "siRNA", "short interfering nucleic acid molecule", "short interfering oligonucleotide molecule", or "chemically modified short interfering nucleic acid molecule" refer to any nucleic acid molecule capable of inhibiting or down regulating gene expression or viral replication by mediating RNA interference ("RNAi") or gene silencing in a sequence-specific manner. These terms can refer to both individual nucleic acid molecules, a plurality of such nucleic acid molecules, or pools of such nucleic acid molecules. The siNA can be a double-stranded nucleic acid molecule comprising self-complementary sense and antisense strands, wherein the antisense strand comprises a nucleotide sequence that is complementary to a nucleotide sequence in a target nucleic acid molecule or a portion thereof and the sense strand comprises a nucleotide sequence corresponding to the target nucleic acid sequence or a portion thereof. The siNA can be a polynucleotide with a duplex, asymmetric duplex, hairpin or asymmetric hairpin secondary structure, having self-complementary sense and antisense regions, wherein the antisense region comprises a nucleotide sequence that is complementary to a nucleotide sequence in a separate target nucleic acid molecule or a portion thereof and the sense region comprises a nucleotide sequence corresponding to the target nucleic acid sequence or a portion thereof. The siNA can be a circular single-stranded polynucleotide having two or more loop structures and a stem comprising self-complementary sense and antisense regions, wherein the antisense region comprises nucleotide sequence that is complementary to a nucleotide sequence in a target nucleic acid molecule or a portion thereof and the sense region comprises a nucleotide sequence corresponding to the target nucleic acid sequence or a portion thereof, and wherein the circular polynucleotide can be processed either in vivo or in vitro to generate an active siNA molecule capable of mediating RNAi. The siNA can also comprise a single-stranded polynucleotide having a nucleotide sequence complementary to nucleotide sequence in a target nucleic acid molecule or a portion thereof (for example, where such siNA molecule does not require the presence within the siNA molecule of a nucleotide sequence corresponding to the target nucleic acid sequence or a portion thereof), wherein the single-stranded polynucleotide can further comprise a terminal phosphate group, such as a 5'-phosphate (see for example, Martinez et al., 2002, *Cell*, 110, 563-574 and Schwarz et al., 2002, *Molecular Cell*, 10, 537-568), or 5',3'-diphosphate.

The term "subject" as used herein refers to its meaning as is generally accepted in the art. The term generally refers an organism to which the nucleic acid molecules of the invention can be administered. A subject can be a mammal or mammalian cells, including a human or human cells. The term also refers to an organism, which is a donor or recipient of explanted cells or the cells themselves.

The phrase "systemic administration" as used herein refers to its meaning as is generally accepted in the art. The term generally refers in vivo systemic absorption or accumulation of drugs in the blood stream followed by distribution throughout the entire body.

The term "target" as it refers to CTNNB1 refers to any CTNNB1 target protein, peptide, or polypeptide, such as encoded by Genbank Accession Nos. shown in Table 5. The term also refers to nucleic acid sequences or target polynucleotide sequence encoding any target protein, peptide, or polypeptide, such as proteins, peptides, or polypeptides encoded by sequences having Genbank Accession Nos. shown in Table 5. The target of interest can include target polynucleotide sequences, such as target DNA or target RNA. The term "target" is also meant to include other sequences, such as differing isoforms, mutant target genes, splice variants of target polynucleotides, target polymorphisms, and non-coding (e.g., ncRNA, miRNA, stRNA, sRNA) or other regulatory polynucleotide sequences as described herein.

The phrase "target site" as used herein refers to its meaning as is generally accepted in the art. The term generally refers to a sequence within a target nucleic acid molecule, (e.g., RNA) that is "targeted", e.g., for cleavage mediated by an siNA construct, which contains sequences within its antisense region that are complementary to the target sequence.

The phrase "therapeutically effective amount" as used herein refers to its meaning as is generally accepted in the art. The term generally refers to the amount of the compound or composition that will elicit the biological or medical response of a cell, tissue, system, animal or human that is be sought by the researcher, veterinarian, medical doctor or other clinician. For example, if a given clinical treatment is considered effective when there is at least a 25% reduction in a measurable parameter associated with a disease or disorder, a therapeutically effective amount of a drug for the treatment of that disease or disorder is that amount necessary to effect at least a 25% reduction in that parameter.

The phrase "universal base" as used herein refers to its meaning as is generally accepted in the art. The term universal base generally refers to nucleotide base analogs that form base pairs with each of the natural DNA/RNA bases with little or no discrimination between them. Non-limiting examples of universal bases include C-phenyl, C-naphthyl and other aromatic derivatives, inosine, azole carboxamides, and nitroazole derivatives such as 3-nitropyrrole, 4-nitroindole, 5-nitroindole, and 6-nitroindole as known in the art (see for example, Loakes, 2001, *Nucleic Acids Research*, 29, 2437-2447).

The term "up-regulate" as used herein refers to its meaning as is generally accepted in the art. With reference to exemplary nucleic acid molecules of the invention, the term refers to an increase in the expression of a gene, or level of RNA molecules or equivalent RNA molecules encoding one or more proteins or protein subunits, or activity of one or more RNAs, proteins or protein subunits, above that observed in the absence of the nucleic acid molecules (e.g., siNA) of the invention. In certain instances, up-regulation or promotion of gene expression with an siNA molecule is above that level observed in the presence of an inactive or attenuated molecule. In other instances, up-regulation or promotion of gene expression with siNA molecules is above that level observed in the presence of, for example, an siNA molecule with scrambled sequence or with mismatches. In still other instances, up-regulation or promotion of gene expression with a nucleic acid molecule of the instant invention is greater in the presence of the nucleic acid molecule than in its absence. In some instances, up-regulation or promotion of gene expression is associated with inhibition of RNA mediated gene silencing, such as RNAi mediated cleavage or silencing of a coding or non-coding RNA target that down regulates, inhibits, or silences the expression of the gene of interest to be up-regulated. The down regulation of gene expression can, for example, be induced by a coding RNA or its encoded protein, such as through negative feedback or antagonistic effects. The down regulation of gene expression can, for example, be induced by a non-coding RNA having regulatory control over a gene of interest, for example by silencing expression of the gene via translational inhibition, chromatin structure, methylation, RISC mediated RNA cleavage, or translational inhibition. As such, inhibition or down regulation of targets that down regulate, suppress, or silence a gene of interest can be used to up-regulate expression of the gene of interest toward therapeutic use.

The term "vector" as used herein refers to its meaning as is generally accepted in the art. The term vector generally refers to any nucleic acid- and/or viral-based expression system or technique used to deliver one or more nucleic acid molecules.

B. siNA Molecules of the Invention

The present invention provides compositions and methods comprising siNAs targeted to CTNNB1 that can be used to treat diseases, e.g., malignancies and/or cancers associated with CTNNB1 expression. In particular aspects and embodiments of the invention, the nucleic acid molecules of the invention comprise at least a 15 nucleotide sequence of the sequences shown in Table 1a and Table 1b. The siNAs can be provided in several forms. For example, the siNA can be isolated as one or more siNA compounds, or it may be in the form of a transcriptional cassette in a DNA plasmid. The siNA may also be chemically synthesized and can include modifications as shown, for example, but not limitation, in Table 1c and Table 6. Thus, in various embodiments, at least one strand or region of the nucleic acids of the invention comprises at least a 15 nucleotide sequence selected from the group of sequences consisting of SEQ ID NOS:1-6374. The siNAs can be administered alone or co-administered with other siNA molecules or with conventional agents that treat a CTNNB1 related disease or condition.

The siNA molecules of the invention can be used to mediate gene silencing, specifically CTNNB1, via interaction with RNA transcripts or alternately by interaction with particular gene sequences, wherein such interaction results in modulation of gene silencing either at the transcriptional level or post-transcriptional level such as, for example, but not limited to, RNAi or through cellular processes that modulate the chromatin structure or methylation patterns of the target and prevent transcription of the target gene, with the nucleotide sequence of the target thereby mediating silencing. More specifically, the target is any of CTNNB1 RNA, DNA, or mRNA, In one aspect, the invention provides short interfering nucleic acid (siNA) molecules for inhibiting the expression of the CTNNB1 gene in a cell or mammal. The siNA can be single-stranded or double-stranded. When double-stranded, the siNA comprising a sense and an antisense stand. The antisense strand is complementary to at least a part of an mRNA formed in the expression of the CTNNB1 gene. The sense strand comprises a region that is complementary to the antisense strand. In specific embodiments, the antisense strand comprises at least a 15 nucleotide sequence of an antisense sequence listed in Table 1b. Generally, the double-stranded siNA comprises at least a 15 nucleotide sequence of the sense strand in Table 1b and at least a 15 nucleotide sequence of the antisense strand in Table 1b. One or more of the nucleotides of the siNAs of the invention are optionally modified. In further embodiments having modifications, some siNAs of the invention comprises at least one nucleotide sequence selected from the groups of sequences provide in Table 1c. In other embodiments, the siNA comprises at least two sequences selected from the group of sequences provided in Table 1c, wherein one of the at least two sequences is complementary to another of the at least two sequences and one of the at least two sequences is complementary to a sequence of a mRNA generated in the expression of the CTNNB1 gene. Examples of certain modified siNAs of the invention are in Table 1c.

The double stranded RNA molecules of the invention can comprise two distinct and separate strands that can be symmetric or asymmetric and are complementary, i.e., two single-stranded RNA molecules, or can comprise one single-stranded molecule in which two complementary portions, e.g., a sense region and an antisense region, are base-paired, and are covalently linked by one or more single-stranded "hairpin" areas (i.e. loops) resulting in, for example, a single-stranded short-hairpin polynucleotide or a circular single-stranded polynucleotide.

The linker can be polynucleotide linker or a non-nucleotide linker. In some embodiments, the linker is a non-nucleotide linker. In some embodiments, a hairpin or circular siNA molecule of the invention contains one or more loop motifs, wherein at least one of the loop portions of the siNA molecule is biodegradable. For example, a single-stranded hairpin siNA molecule of the invention is designed such that degradation of the loop portion of the siNA molecule in vivo can generate a double-stranded siNA molecule with 3'-terminal overhangs, such as 3'-terminal nucleotide overhangs comprising 1, 2, 3 or 4 nucleotides. Or alternatively, a circular siNA molecule of the invention is designed such that degradation of the loop portions of the siNA molecule in vivo can generate a double-stranded siNA molecule with 3'-terminal overhangs, such as 3'-terminal nucleotide overhangs comprising about 2 nucleotides.

In symmetric siNA molecules of the invention, each strand, the sense (passenger) strand and antisense (guide) strand, are independently about 15 to about 30 (e.g., about 15, 16, 17, 18, 19, 20, 21, 22, 23, 24, 25, 26, 27, 28, 29, or 30) nucleotides in length. Generally, each strand of the symmetric siNA molecules of the invention are about 19-24 (e.g., about 19, 20, 21, 22, 23 or 24) nucleotides in length.

In asymmetric siNA molecules, the antisense region or strand of the molecule is about 15 to about 30 (e.g., about 15, 16, 17, 18, 19, 20, 21, 22, 23, 24, 25, 26, 27, 28, 29, or 30) nucleotides in length, wherein the sense region is about 3 to about 25 (e.g., about 3, 4, 5, 6, 7, 8, 9, 10, 11, 12, 13, 14, 15, 16, 17, 18, 19, 20, 21, 22, 23, 24, or 25) nucleotides in length. Generally, each strand of the asymmetric siNA molecules of the invention is about 19-24 (e.g., about 19, 20, 21, 22, 23 or 24) nucleotides in length.

In yet other embodiments, siNA molecules of the invention comprise single stranded hairpin siNA molecules, wherein the siNA molecules are about 25 to about 70 (e.g., about 25, 26, 27, 28, 29, 30, 31, 32, 33, 34, 35, 36, 40, 45, 50, 55, 60, 65, or 70) nucleotides in length.

In still other embodiments, siNA molecules of the invention comprise single-stranded circular siNA molecules, wherein the siNA molecules are about 38 to about 70 (e.g., about 38, 40, 45, 50, 55, 60, 65, or 70) nucleotides in length.

In still other embodiments, siNA molecules of the invention comprise single-stranded non-circular siNA molecules, wherein the siNA molecules are independently about 15 to about 30 (e.g., about 15, 16, 17, 18, 19, 20, 21, 22, 23, 24, 25, 26, 27, 28, 29, or 30) nucleotides in length.

In various symmetric embodiments, the siNA duplexes of the invention independently comprise about 15 to about 30 (e.g., about 15, 16, 17, 18, 19, 20, 21, 22, 23, 24, 25, 26, 27, 28, 29, or 30) base pairs. Generally, the duplex structure of siNAs of the invention is between 15 and 30, more generally between 18 and 25, yet more generally between 19 and 24, and most generally between 19 and 21 base pairs in length.

In yet other embodiments, where the duplex siNA molecules of the invention are asymmetric, the siNA molecules comprise about 3 to 25 (e.g., about 3, 4, 5, 6, 7, 8, 9, 10, 11, 12, 13, 14, 15, 16, 17, 18, 19, 20, 21, 22, 23, 24, or 25) base pairs. Generally, the duplex structure of siNAs of the invention is between 15 and 25, more generally between 18 and 25, yet more generally between 19 and 24, and most generally between 19 and 21 base pairs in length.

In still other embodiments, where the siNA molecules of the invention are hairpin or circular structures, the siNA molecules comprise about 15 to about 30 (e.g., about 15, 16, 17, 18, 19, 20, 21, 22, 23, 24, 25, 26, 27, 28, 29, or 30) base pairs.

The sense strand and antisense strand, or the sense region and antisense region, of the siNA molecules of the invention can be complementary. Also, the antisense strand or antisense region can be complementary to a nucleotide sequence or a portion thereof of the CTNNB1 target RNA. The sense strand or sense region of the siNA can comprise a nucleotide sequence of a CTNNB1 gene or a portion thereof. In certain embodiments, the sense region or sense strand of an siNA molecule of the invention is complementary to that portion of the antisense region or antisense strand of the siNA molecule that is complementary to a CTNNB1 target polynucleotide sequence, such as for example, but not limited to, those sequences represented by GENBANK Accession Nos. shown in Table 5.

In some embodiments, siNA molecules of the invention have perfect complementarity between the sense strand or sense region and the antisense strand or antisense region of the siNA molecule. In other or the same embodiments, the antisense strand of the siNA molecules of the invention are perfectly complementary to a corresponding target nucleic acid molecule.

In yet other embodiments, siNA molecules of the invention have partial complementarity (i.e., less than 100% complementarity) between the sense strand or sense region and the antisense strand or antisense region of the siNA molecule or between the antisense strand or antisense region of the siNA molecule and a corresponding target nucleic acid molecule. Thus, in some embodiments, the double-stranded nucleic acid molecules of the invention, have between about 15 to about 30 (e.g., about 15, 16, 17, 18, 19, 20, 21, 22, 23, 24, 25, 26, 27, 28, 29, or 30) nucleotides in one strand that are complementary to the nucleotides of the other strand. In other embodiments, the molecules have between about 15 to about 30 (e.g., about 15, 16, 17, 18, 19, 20, 21, 22, 23, 24, 25, 26, 27, 28, 29, or 30) nucleotides in the sense region that are complementary to the nucleotides of the antisense region. of the double-stranded nucleic acid molecule. In certain embodiments, the double-stranded nucleic acid molecules of the invention have between about 15 to about 30 (e.g., about 15, 16, 17, 18, 19, 20, 21, 22, 23, 24, 25, 26, 27, 28, 29, or 30) nucleotides in the antisense strand that are complementary to a nucleotide sequence of its corresponding target nucleic acid molecule.

In other embodiments, the siNA molecule can contain one or more nucleotide deletions, substitutions, mismatches and/or additions; provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair. Thus, in some embodiments, for example, the double-stranded nucleic acid molecules of the invention, have 1 or more (e.g., 1, 2, 3, 4, 5, or 6) nucleotides, in one strand or region that are mismatches or non-base-paired with the other strand or region. In other embodiments, the double-stranded nucleic acid molecules of the invention, have 1 or more (e.g., 1, 2, 3, 4, 5, or 6) nucleotides in each strand or region that are mismatches or non-base-paired with the other strand or region. In a preferred embodiment, the siNA of the invention contains no more than 3 mismatches. If the antisense strand of the siNA contains mismatches to a target sequence, it is preferable that the area of mismatch not be located in the center of the region of complementarity.

In other embodiments, the siNA molecule can contain one or more nucleotide deletions, substitutions, mismatches and/or additions to a sequence in Table 1b provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

The invention also comprises double-stranded nucleic acid (siNA) molecules as otherwise described hereinabove in which the first strand and second strand are complementary to each other and wherein at least one strand is hybridisable to the polynucleotide sequence of a sequence in Table 1b under conditions of high stringency, and wherein any of the nucleotides is unmodified or chemically modified.

Hybridization techniques are well known to the skilled artisan (see for instance, Sambrook et al., Molecular Cloning: A Laboratory Manual, 2nd Ed., Cold Spring Harbor Laboratory Press, Cold Spring Harbor, N.Y. (1989)). Preferred stringent hybridization conditions include overnight incubation at 42° C. in a solution comprising: 50% formamide, 5×SSC (150 mM NaCl, 15 mM trisodium citrate), 50 mM sodium phosphate (pH 7.6), 5×Denhardt's solution, 10% dextran sulfate, and 20 microgram/ml denatured, sheared salmon sperm DNA; followed by washing the filters in 0.1×SSC at about 65° C.

In one specific embodiment, the first strand has about 15, 16, 17, 18, 19, 20 or 21 nucleotides that are complementary to the nucleotides of the other strand and at least one strand is hybridisable to a polynucleotide sequence in Table 1b. In a more preferred embodiment, the first strand has about 15, 16, 17, 18, 19, 20 or 21 nucleotides that are complementary to the nucleotides of the other strand and at least one strand is hybridisable to SEQ ID NO: 1, SEQ ID NO: 1049, SEQ ID NO: 43, SEQ ID NO: 1091, SEQ ID NO: 51, SEQ ID NO: 1099, SEQ ID NO: 53, or SEQ ID NO:1101; under conditions of high stringency, and wherein any of the nucleotides is unmodified or chemically modified.

In certain embodiments, the siNA molecules of the invention comprise overhangs of about 1 to about 4 (e.g., about 1, 2, 3 or 4) nucleotides. The nucleotides in the overhangs can be the same or different nucleotides. In some embodiments, the overhangs occur at the 3'-end at one or both strands of the double-stranded nucleic acid molecule. For example, a double-stranded nucleic acid molecule of the invention can comprise a nucleotide or non-nucleotide overhang at the 3'-end of the antisense strand/region, the 3'-end of the sense strand/region, or both the antisense strand/region and the sense strand/region of the double-stranded nucleic acid molecule.

In some embodiments, the nucleotides comprising the overhang portion of an siNA molecule of the invention comprise sequences based on the CTNNB1 target polynucleotide sequence in which nucleotides comprising the overhang portion of the antisense strand/region of an siNA molecule of the invention can be complementary to nucleotides in the CTNNB1 target polynucleotide sequence and/or nucleotides comprising the overhang portion of the sense strand/region of an siNA molecule of the invention can comprise the nucleotides in the CTNNB1 target polynucleotide sequence. Thus, in some embodiments, the overhang comprises a two nucleotide overhang that is complementary to a portion of the CTNNB1 target polynucleotide sequence. In other embodiments, however, the overhang comprises a two nucleotide overhang that is not complementary to a portion of the CTNNB1 target polynucleotide sequence. In certain embodiments, the overhang comprises a 3'-UU overhang that is not complementary to a portion of the CTNNB1 target polynucleotide sequence. In other embodiments, the overhang comprises a UU overhang at the 3' end of the antisense strand and a TT overhang at the 3' end of the sense strand. In other embodiments, the overhang comprises nucleotides as described in the examples, Tables, and Figures herein.

In any of the embodiments of the siNA molecules described herein having 3'-terminal nucleotide overhangs, the overhangs are optionally chemically modified at one or more nucleic acid sugar, base, or backbone positions. Representative, but not limiting examples of modified nucleotides in the overhang portion of a double-stranded nucleic acid (siNA) molecule of the invention include: 2'-O-alkyl (e.g., 2'-O-methyl), 2'-deoxy, 2'-deoxy-2'-fluoro, 2'-deoxy-2'-fluoroarabino (FANA), 4'-thio, 2'-O-trifluoromethyl, 2'-O-ethyl-trifluoromethoxy, 2'-O-difluoromethoxy-ethoxy, universal base, acyclic, or 5-C-methyl nucleotides. In more preferred embodiments, the overhang nucleotides are each independently, a 2'-O-alkyl nucleotide, a 2'-O-methyl nucleotide, a 2'-dexoy-2-fluoro nucleotide, or a 2'-deoxy ribonucleotide. In some instances the overhang nucleotides are linked by a one or more phosphorothioate linkages.

In yet other embodiments, siNA molecules of the invention comprise duplex nucleic acid molecules with blunt ends (i.e., without nucleotide overhangs), where both ends are blunt, or alternatively, where one of the ends is blunt. In some embodiments, the siNA molecules of the invention can comprises one blunt end, for example wherein the 5'-end of the antisense strand and the 3'-end of the sense strand do not have any overhanging nucleotides. In another example, the siNA molecule comprises one blunt end, for example wherein the 3'-end of the antisense strand and the 5'-end of the sense strand do not have any overhanging nucleotides. In other embodiments, siNA molecules of the invention comprise two blunt ends, for example wherein the 3'-end of the antisense strand and the 5'-end of the sense strand as well as the 5'-end of the antisense strand and 3'-end of the sense strand do not have any overhanging nucleotides.

In any of the embodiments or aspects of the siNA molecules of the invention, the sense strand and/or the antisense strand can further have a cap, such as described herein or as known in the art, at the 3'-end, the 5'-end, or both of the 3' and 5'-ends of the sense strand and/or antisense strand. Or as in the case of a hairpin siNA molecule, the cap can be at either one or both of the terminal nucleotides of the polynucleotide. In some embodiments, the cap is at one of both of the ends of the sense strand of a double-stranded siNA molecule. In other embodiments, the cap is at the 3'-end of antisense (guide) strand. In preferred embodiments, the caps are at the 3'-end of the sense strand and the 5'-end of the sense strand.

Representative, but non-limiting examples of such terminal caps include an inverted abasic nucleotide, an inverted deoxy abasic nucleotide, an inverted nucleotide moiety, a group shown in FIG. 5, a glyceryl modification, an alkyl or cycloalkyl group, a heterocycle, or any other cap as is generally known in the art.

Any of the embodiments of the siNA molecules of the invention can have a 5' phosphate termini. In some embodiments, the siNA molecules lack terminal phosphates.

Any siNA molecule or construct of the invention can comprise one or more chemical modifications. Modifications can be used to improve in vitro or in vivo characteristics such as stability, activity, toxicity, immune response (e.g., prevent stimulation of an interferon response, an inflammatory or pro-inflammatory cytokine response, or a Toll-like Receptor (TlF) response), and/or bioavailability.

Applicants describe herein chemically modified siNA molecules with improved RNAi activity and/or stability compared to corresponding unmodified siNA molecules. Various chemically modified siNA motifs disclosed herein provide the capacity to maintain RNAi activity that is substantially similar to unmodified or minimally modified active siRNA (see for example Elbashir et al., 2001, EMBO J., 20:6877-6888) while at the same time providing nuclease resistance and pharmacokinetic properties suitable for use in therapeutic applications.

In various embodiments, the siNA molecules of the invention comprise modifications wherein any (e.g., one or more or all) nucleotides present in the sense and/or antisense strand are modified nucleotides (e.g., wherein one nucleotide is modified, some nucleotides (i.e., plurality or more than one) are modified, or all nucleotides are modified nucleotides. In some embodiments, the siNA molecules of the invention are partially modified (e.g., about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 55, or 59 nucleotides are modified) with chemical modifications. In some embodiments, an siNA molecule of the invention comprises at least about 8, 10, 12, 14, 16, 18, 20, 22, 24, 26, 28, 30, 32, 34, 36, 38, 40, 42, 44, 46, 48, 50, 52, 54, 56, 58, or 60 nucleotides that are modified nucleotides. In other embodiments, the siNA molecules of the invention are completely modified (e.g., 100% modified) with chemical modifications, i.e., the siNA molecule does not contain any ribonucleotides. In some of embodiments, one or more of the nucleotides in the sense strand of the siNA molecules of the invention are modified. In the same or other embodiments, one or more of the nucleotides in the antisense strand of the siNA molecules of the invention are modified.

The chemical modification within a single siNA molecule can be the same or different. In some embodiments, at least one strand has at least one chemical modification. In other embodiments, each strand has at least one chemical modifications, which can be the same or different, such as, sugar, base, or backbone (i.e., internucleotide linkage) modifications. In other embodiments, siNA molecules of the invention contain at least 2, 3, 4, 5, or more different chemical modifications.

Non-limiting examples of chemical modifications that are suitable for use in the present invention, are disclosed in U.S. patent application Ser. Nos. 10/444,853; 10/981,966; 12/064, 014 and in references cited therein and include sugar, base, and phosphate, non-nucleotide modifications, and/or any combination thereof.

In certain specific embodiments of the invention, at least one modified nucleotide is a 2'-deoxy-2-fluoro nucleotide, a 2'-deoxy nucleotide, a 2'-O-alkyl (e.g., 2'-O-methyl) nucleotide, or a locked nucleic acid (LNA) nucleotide as is generally recognized in the art.

In yet other embodiment of the invention, at least one nucleotide has a ribo-like, Northern or A form helix configuration (see e.g., Saenger, Principles of Nucleic Acid Structure, Springer-Verlag ed., 1984). Non-limiting examples of nucleotides having a Northern configuration include locked nucleic acid (LNA) nucleotides (e.g., 2'-O, 4'-C-methylene-(D-ribofuranosyl) nucleotides); 2'-methoxyethoxy (MOE) nucleotides; 2'-methyl-thio-ethyl nucleotides, 2'-deoxy-2'-fluoro nucleotides; 2'-deoxy-2'-chloro nucleotides; 2'-azido nucleotides; 2'-O-trifluoromethyl nucleotides; 2'-O-ethyl-trifluoromethoxy nucleotides; 2'-O-difluoromethoxy-ethoxy nucleotides; 4'-thio nucleotides and 2'-O-methyl nucleotides.

In various embodiments, a majority (e.g., greater than 50%) of the pyrimidine nucleotides present in the double-stranded siNA molecule comprises a sugar modification. In some of the same and/or other embodiments, a majority (e.g., greater than 50%) of the purine nucleotides present in the double-stranded siNA molecule comprises a sugar modification.

In some embodiments, the pyrimidine nucleotides in the antisense strand are 2'-O-methyl or 2'-deoxy-2'-fluoro pyrimidine nucleotides and the purine nucleotides present in the antisense strand are 2'-O-methyl nucleotides or 2'-deoxy nucleotides. In other embodiments, the pyrimidine nucleotides in the sense strand are 2'-deoxy-2'-fluoro pyrimidine nucleotides and the purine nucleotides present in the sense strand are 2'-O-methyl or 2'-deoxy purine nucleotides.

In certain embodiments of the invention, all the pyrimidine nucleotides in the complementary region on the sense strand are 2'-deoxy-2'-fluoro pyrimidine nucleotides. In certain embodiments, all of the pyrimidine nucleotides in the complementary region of the antisense strand are 2'-deoxy-2'-fluoro pyrimidine nucleotides. In certain embodiments, all the purine nucleotides in the complementary region on the sense strand are 2'-deoxy purine nucleotides. In certain embodiments, all of the purines in the complementary region on the antisense strand are 2'-O-methyl purine nucleotides. In certain embodiments, all of the pyrimidine nucleotides in the complementary regions on the sense strand are 2'-deoxy-2'-fluoro pyrimidine nucleotides; all of the pyrimidine nucleotides in the complementary region of the antisense strand are 2'-deoxy-2'-fluoro pyrimidine nucleotides; all the purine nucleotides in the complementary region on the sense strand are 2'-deoxy purine nucleotides and all of the purines in the complementary region on the antisense strand are 2'-O-methyl purine nucleotides.

In some embodiments, at least 5 or more of the pyrimidine nucleotides in one or both stands are 2'-deoxy-2'-fluoro pyrimidine nucleotides. In some embodiments, at least 5 or more of the pyrimidine nucleotides in one or both stands are 2'-O-methylpyrimidine nucleotides. In some embodiments, at least 5 or more of the purine nucleotides in one or both stands are 2'-deoxy-2'-fluoro purine nucleotides In some embodiments, at least 5 or more of the purine nucleotides in one or both stands are 2'-O-methyl purine nucleotides.

In certain embodiments, the purines and pyrimidines are differentially modified at the 2'-sugar position (i.e., at least one purine has a different modification from at least one pyrimidine in the same or different strand at the 2'-sugar position). For example, in some instances, at least 5 or more of the pyrimidine nucleotides in one or both stands are 2'-deoxy-2'-fluoro pyrimidine nucleotides and at least 5 or more purine nucleotides in one or both strands are 2'-O-methyl purine nucleotides. In other instances at least 5 or more of the pyrimidine nucleotides in one or both stands are 2'-O-methylpyrimidine nucleotides and at least 5 or more purine nucleotides in one or both stands are 2'-deoxy-2'-fluoro purine nucleotides.

Further non-limiting examples of sense and antisense strands of such siNA molecules having various modifications and modifications patterns are shown in FIGS. 2 and 3.

Any of the above described modifications, or combinations thereof, including those in the references cited, can be applied to any of the siNA molecules of the invention.

The modified siNA molecules of the invention can comprise modifications at various locations within the siNA molecule. In some embodiments, the double-stranded siNA molecule of the invention comprises modified nucleotides at internal base paired positions within the siNA duplex. In other embodiments, a double-stranded siNA molecule of the invention comprises modified nucleotides at non-base paired or overhang regions of the siNA molecule. In yet other embodiments, a double-stranded siNA molecule of the invention comprises modified nucleotides at terminal positions of the siNA molecule. For example, such terminal regions include the 3'-position and/or 5'-position of the sense and/or antisense strand or region of the siNA molecule. Additionally, any of the modified siNA molecules of the invention can have a modification in one or both oligonucleotide strands of the siNA duplex, for example in the sense strand, the antisense strand, or both strands. Moreover, with regard to chemical modifications of the siNA molecules of the invention, each strand of the double-stranded siNA molecules of the invention can have one or more chemical modifications, such that each strand comprises a different pattern of chemical modifications.

In certain embodiments each strand of a double-stranded siNA molecule of the invention comprises a different pattern of chemical modifications, such as any Stab modification chemistries described herein (see Table 9) or any combination thereof, i.e., different combinations of defined Stabilzation chemistry (Stab) sense and antisense strands. Further, non-limiting examples of modification schemes that could give rise to different patterns of modifications are shown in Table 9. The stabilization chemistries referred to in Table 9 as Stab, can be combined in any combination of sense/antisense chemistries, such as Stab 7/8, Stab 7/11, Stab 8/8, Stab 18/8, Stab 18/11, Stab 12/13, Stab 7/13, Stab 18/13, Stab 7/19, Stab 8/19, Stab 18/19, Stab 7/20, Stab 8/20, Stab 18/20, Stab 7/32, Stab 8/32, or Stab 18/32 or any other combination of Stabilization chemistries.

In any of the siNAs of the invention, one or more (for example 1, 2, 3, 4 or 5) nucleotides at the 5'-end of the guide strand or guide region (also known as antisense strand or antisense region) of the siNA molecule are ribonucleotides.

In certain embodiments, the present invention provides a double-stranded short interfering nucleic acid (siNA) molecule that modulates the expression of CTNNB1, wherein the siNA comprises a sense strand and an antisense strand; each strand is independently 15 to 30 nucleotides in length; and the antisense strand comprises at least 15, 16, 17, 18, or 19 nucleotides having sequence complementary to any of:
  5'-CUGUUGGAUUGAUUCGAAA-3' (SEQ ID NO: 5);
  5'-ACGACUAGUUCAGUUGCUU-3' (SEQ ID NO: 194);
  5'-GGAUGAUCCUAGCUAUCGU-3' (SEQ ID NO: 196); or
  5'-CCAGGAUGAUCCUAGCUAU-3' (SEQ ID NO: 151).

In some embodiments, the antisense strand of a siNA molecule of the invention comprises at least a 15, 16, 17, 18, or 19 nucleotide sequence of:
  5'-UUUCGAAUCAAUCCAACAG-3' (SEQ ID NO: 4918);
  5'-AAGCAACUGAACUAGUCGU-3' (SEQ ID NO: 5107);
  5'-ACGAUAGCUAGGAUCAUCC-3' (SEQ ID NO: 5109); or
  5'-AUAGCUAGGAUCAUCCUGG-3' (SEQ ID NO: 5064).

In some embodiments, the sense strand of a siNA molecule of the invention comprises at least a 15, 16, 17, 18, or 19 nucleotide sequence of:
  5'-CUGUUGGAUUGAUUCGAAA-3' (SEQ ID NO: 5);
  5'-ACGACUAGUUCAGUUGCUU-3' (SEQ ID NO: 194);
  5'-GGAUGAUCCUAGCUAUCGU-3' (SEQ ID NO: 196); or
  5'-CCAGGAUGAUCCUAGCUAU-3' (SEQ ID NO: 151).

In some embodiments, a siNA molecule of the invention comprises any of:
  5'-CUGUUGGAUUGAUUCGAAA-3' (SEQ ID NO: 5) and 5'-UUUCGAAUCAAUCCAACAG-3' (SEQ ID NO: 4918); or
  5'-ACGACUAGUUCAGUUGCUU-3' (SEQ ID NO: 194) and 5'-AAGCAACUGAACUAGUCGU-3' (SEQ ID NO: 5107); or
  5'-GGAUGAUCCUAGCUAUCGU-3' (SEQ ID NO: 196) and 5'-ACGAUAGCUAGGAUCAUCC-3' (SEQ ID NO: 5109); or
  5'-CCAGGAUGAUCCUAGCUAU-3' (SEQ ID NO: 151) and 5'-AUAGCUAGGAUCAUCCUGG-3' (SEQ ID NO: 5064).

Any of the above described modifications, or combinations thereof, including those in the references cited, can be applied to any of these embodiments.

In certain embodiments, the nucleotides of the at least a 15, 16, 17, 18, or 19 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064 form a contiguous stretch of nucleotides.

In some embodiments, the siNA molecule can contain one or more nucleotide deletions, substitutions, mismatches and/or additions to the at least 15, 16, 17, 18, or 19 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064; provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

In certain embodiments of the invention, double-stranded siNA molecules are provided, wherein the molecule has a sense strand and an antisense strand and comprises the following formula (A):

wherein, the upper strand is the sense strand and the lower strand is the antisense strand of the double-stranded nucleic acid molecule; wherein the antisense strand comprises at least a 15, 16, 17, 18, or 19 nucleotide sequence of SEQ ID NO: 4918, SEQ ID NO: 5107, SEQ ID NO: 5109, or SEQ ID NO: 5064, and the sense strand comprises a sequence having complementarity to the antisense strand;

each N is independently a nucleotide which is unmodified or chemically modified or a non-nucleotide;
each B is a terminal cap that is present or absent;
(N) represents overhanging nucleotides, each of which is independently unmodified or chemically modified;
[N] represents nucleotides that are ribonucleotides;
X1 and X2 are independently integers from 0 to 4;
X3 is an integer from 15 to 30;
X4 is an integer from 9 to 30; and
X5 is an integer from 0 to 6, provided that the sum of X4 and X5 is 15-30.

In certain embodiments, the nucleotides of the at least a 15, 16, 17, 18, or 19 nucleotide sequence of SEQ ID NO: 4918, SEQ ID NO: 5107, SEQ ID NO: 5109, or SEQ ID NO: 5064 form a contiguous stretch of nucleotides.

In some embodiments, the siNA molecule of formula A can contain one or more nucleotide deletions, substitutions, mismatches and/or additions to the at least 15, 16, 17, 18, or 19 nucleotide sequence of SEQ ID NO: 4918, SEQ ID NO: 5107, SEQ ID NO: 5109, or SEQ ID NO: 5064; provided, however, that the siNA molecule maintains its activity, for example, to mediate RNAi. In a non-limiting example, the deletion, substitution, mismatch and/or addition can result in a loop or bulge, or alternately a wobble or other alternative (non Watson-Crick) base pair.

In one embodiment, the invention features a double-stranded short interfering nucleic acid (siNA) of formula (A); wherein
(a) one or more pyrimidine nucleotides in $N_{X4}$ positions are independently 2'-deoxy-2'-fluoro nucleotides, 2'-O-alkyl nucleotides, 2'-deoxy nucleotides, ribonucleotides, or any combination thereof;
(b) one or more purine nucleotides in $N_{X4}$ positions are independently 2'-deoxy-2'-fluoro nucleotides, 2'-O-alkyl nucleotides, 2'-deoxy nucleotides, ribonucleotides, or any combination thereof;
(c) one or more pyrimidine nucleotides in $N_{X3}$ positions are independently 2'-deoxy-2'-fluoro nucleotides, 2'-O-alkyl nucleotides, 2'-deoxy nucleotides, ribonucleotides, or any combination thereof; and
(d) one or more purine nucleotides in $N_{X3}$ positions are independently 2'-deoxy-2'-fluoro nucleotides, 2'-O-alkyl nucleotides, 2'-deoxy nucleotides, ribonucleotides, or any combination thereof.

In certain embodiments, the invention features a double-stranded short interfering nucleic acid (siNA) molecule of formula (A); wherein
(a) 1, 2, 3, 4, 5 or more pyrimidine nucleotides in $N_{X4}$ positions are 2'-deoxy-2'-fluoro nucleotides;
(b) 1, 2, 3, 4, 5 or more purine nucleotides in $N_{X4}$ positions are 2'-O-alkyl nucleotides;
(c) 1, 2, 3, 4, 5 or more pyrimidine nucleotides in $N_{X3}$ positions are 2'-deoxy-2'-fluoro nucleotides; and
(d) 1, 2, 3, 4, 5 or more purine nucleotides in $N_{X3}$ positions are 2'-deoxy nucleotides.

In certain embodiments, the invention features a double-stranded short interfering nucleic acid (siNA) molecule of formula (A); wherein
(a) 1, 2, 3, 4, 5 or more pyrimidine nucleotides in $N_{X4}$ positions are 2'-O-alkyl nucleotides;
(b) 1, 2, 3, 4, 5 or more purine nucleotides in $N_{X4}$ positions are ribonucleotides;
(c) 1, 2, 3, 4, 5 or more pyrimidine nucleotides in $N_{X3}$ positions are 2'-O-alkyl nucleotides; and
(d) 1, 2, 3, 4, 5 or more purine nucleotides in $N_{X3}$ positions are ribonucleotides.

In certain embodiments, the invention features a double-stranded short interfering nucleic acid (siNA) molecule of formula (A); wherein
(a) 1, 2, 3, 4, 5 or more pyrimidine nucleotides in $N_{X4}$ positions are 2'-deoxy-2'-fluoro nucleotides;
(b) 1, 2, 3, 4, 5 or more purine nucleotides in $N_{X4}$ positions are 2'-O-alkyl nucleotides;
(c) 1, 2, 3, 4, 5 or more pyrimidine nucleotides in $N_{X3}$ positions are 2'-O-alkyl nucleotides; and
(d) 1, 2, 3, 4, 5 or more purine nucleotides in $N_{X3}$ positions are 2'-deoxy-2'-fluoro nucleotides.

In certain embodiments, the invention features a double-stranded short interfering nucleic acid (siNA) molecule of formula (A) further comprising one or more phosphorothioate internucleotide linkages.

In some embodiments, siNA molecules having formula A comprise a terminal phosphate group at the 5'-end of the antisense strand or antisense region of the nucleic acid molecule.

In various embodiments, siNA molecules having formula A comprise X5=0, 1, 2, or 3; each X1 and X2=1 or 2; X3=18, 19, 20, 21, 22, or 23, and X4=17, 18, 19, 20, 21, 22, or 23.

In certain embodiments, siNA molecules having formula A comprise X5=3. In other embodiments siNA molecules having formula A comprise X5=0.

In certain embodiments, siNA molecules having formula A comprise X1=2 and X2=2.

In various embodiments, siNA molecules having formula A comprise X5=0, X1=2, and X2=2. In other embodiments, siNA molecules having formula A comprise X5=3, X1=2, and X2=2.

In one specific embodiment, an siNA molecule having formula A comprises X5=3; each X1 and X2=2; X3=19, and X4=16.

In another specific embodiment, an siNA molecule having formula A comprises X5=0; each X1 and X2=2; X3=19, and X4=19.

In certain embodiments, siNA molecules having formula A comprise caps (B) at the 3' and 5' ends of the sense strand or sense region.

In certain embodiments, siNA molecules having formula A comprise caps (B) at the 3'-end of the antisense strand or antisense region.

In various embodiments, siNA molecules having formula A comprise caps (B) at the 3' and 5' ends of the sense strand or sense region and caps (B) at the 3'-end of the antisense strand or antisense region.

In yet other embodiments, siNA molecules having formula A comprise caps (B) only at the 5'-end of the sense (upper) strand of the double-stranded nucleic acid molecule.

In some embodiments, siNA molecules having formula A further comprise one or more phosphorothioate internucleotide linkages between the nucleotides. In certain embodiments, siNA molecules having formula A comprise one or more phosphorothioate internucleotide linkages between the first terminal (N) and the adjacent nucleotide on the 3' end of the sense strand, antisense strand, or both sense strand and antisense strands of the nucleic acid molecule. For example, a double-stranded nucleic acid molecule can comprise X1 and/or X2=2 having overhanging nucleotide positions with a phosphorothioate internucleotide linkage, e.g., (NsN) where "s" indicates phosphorothioate.

In some embodiments, one or more of the nucleotides of siNA molecules having formula A have a universal base.

In certain embodiments, siNA molecules having formula A have at position 14 from the 5'-end of the antisense strand a ribonucleotide when the nucleotide at that position 14 is a purine. In other embodiments, siNA molecules having formula A have at position 14 from the 5'-end of the antisense strand a ribonucleotide, a 2'-deoxy-2'-fluoro nucleotide or a 2'-O-methyl nucleotide when the nucleotide at that position 14 is a pyrimidine nucleotide.

In some embodiments, siNA molecules having formula A comprises (N) nucleotides in the antisense strand (lower strand) that are complementary to nucleotides in a CTNNB1 target polynucleotide sequence, which also has complementarity to the N and [N] nucleotides of the antisense (lower) strand.

In certain embodiments, one or more siNA molecules of the invention are modified according to modification criteria as shown and described in U.S. Ser. No. 61/408,428 and U.S. Ser. No. 61/408,303, both of which are incorporated by reference herein.

Any of the above described modifications, or combinations thereof, discussed above as applicable to siNAs of the invention, including those in the references cited, can be applied to any of the embodiments to siNA molecules of the present invention.

C. Generation/Synthesis of siNA Molecules

The siNAs of the invention can be obtained using a number of techniques known to those of skill in the art. For example the siNA can be chemically synthesized or may be encoded by plasmid (e.g., transcribed as sequences that automatically fold into duplexes with hairpin loops.). siNA can also be generated by cleavage of longer dsRNA (e.g., dsRNA greater than about 25 nucleotides in length) by the *E coli* RNase II or Dicer. These enzymes process the dsRNA into biologically active siNA (see, e.g., Yang et al., PNAS USA 99:9942-9947 (2002); Calegari et al. *PNAS USA* 99:14236 (2002) Byron et al. Ambion Tech Notes; 10 (1):4-6 (2009); Kawaski et al., *Nucleic Acids Res.*, 31:981-987 (2003), Knight and Bass, *Science*, 293:2269-2271 (2001) and Roberston et al., *J. Biol. Chem* 243:82 (1969).

1. Chemical Synthesis

Preferably, siNA of the invention are chemically synthesized. Oligonucleotides (e.g., certain modified oligonucleotides or portions of oligonucleotides lacking ribonucleotides) are synthesized using protocols known in the art, for example as described in Caruthers et al., 1992, *Methods in Enzymology* 211, 3-19, Thompson et al., International PCT Publication No. WO 99/54459, Wincott et al., 1995, *Nucleic Acids Res.* 23, 2677-2684, Wincott et al., 1997, *Methods Mol. Bio.*, 74, 59, Brennan et al., 1998, *Biotechnol Bioeng.*, 61, 33-45, and Brennan, U.S. Pat. No. 6,001,311. The synthesis of oligonucleotides makes use of common nucleic acid protecting and coupling groups, such as dimethoxytrityl at the 5'-end, and phosphoramidites at the 3'-end.

siNA molecules without modifications are synthesized using procedures as described in Usman et al., 1987, *J. Am. Chem. Soc.*, 109, 7845; Scaringe et al., 1990, *Nucleic Acids Res.*, 18, 5433. These syntheses makes use of common nucleic acid protecting and coupling groups, such as dimethoxytrityl at the 5'-end, and phosphoramidites at the 3'-end that can be used for certain siNA molecules of the invention.

In certain embodiments, the siNA molecules of the invention are synthesized, deprotected, and analyzed according to methods described in U.S. Pat. Nos. 6,995,259, 6,686,463, 6,673,918, 6,649,751, 6,989,442, and U.S. patent application Ser. No. 10/190,359.

In a non-limiting synthesis example, small scale syntheses are conducted on a 394 Applied Biosystems, Inc. synthesizer using a 0.2 μmol scale protocol with a 2.5 min coupling step for 2'-O-methylated nucleotides and a 45 second coupling step for 2'-deoxy nucleotides or 2'-deoxy-2'-fluoro nucleotides. Table 10 outlines the amounts and the contact times of the reagents used in the synthesis cycle.

Alternatively, the siNA molecules of the present invention can be synthesized separately and joined together post-synthetically, for example, by ligation (Moore et al., 1992, *Science* 256, 9923; Draper et al., International PCT Publication No. WO 93/23569; Shabarova et al., 1991, *Nucleic Acids Research* 19, 4247; Bellon et al., 1997, *Nucleosides & Nucleotides*, 16, 951; Bellon et al., 1997, *Bioconjugate Chem.* 8, 204), or by hybridization following synthesis and/or deprotection.

Various siNA molecules of the invention can also be synthesized using the teachings of Scaringe et al., U.S. Pat. Nos. 5,889,136; 6,008,400; and 6,111,086.

2. Vector Expression

Alternatively, siNA molecules of the invention that interact with and down-regulate gene encoding target CTNNB1 molecules can be expressed and delivered from transcription units (see for example Couture et al., 1996, *TIG.*, 12, 510) inserted into DNA or RNA vectors. The recombinant vectors can be DNA plasmids or viral vectors. siNA expressing viral vectors can be constructed based on, but not limited to, adeno-associated virus, retrovirus, adenovirus, or alphavirus.

In some embodiments, pol III based constructs are used to express nucleic acid molecules of the invention. Transcription of the siNA molecule sequences can be driven from a promoter for eukaryotic RNA polymerase I (pol I), RNA polymerase II (pol II), or RNA polymerase III (pol III). (see for example, Thompson, U.S. Pat. Nos. 5,902,880 and 6,146, 886). (See also, Izant and Weintraub, 1985, *Science*, 229, 345; McGarry and Lindquist, 1986, *Proc. Natl. Acad. Sci., USA* 83, 399; Scanlon et al., 1991, *Proc. Natl. Acad. Sci. USA*, 88, 10591-5; Kashani-Sabet et al., 1992, *Antisense Res. Dev.*, 2, 3-15; Dropulic et al., 1992, *J. Virol.*, 66, 1432-41; Weerasinghe et al., 1991, *J. Virol.*, 65, 5531-4; Ojwang et al., 1992, *Proc. Natl. Acad. Sci. USA*, 89, 10802-6; Chen et al., 1992, *Nucleic Acids Res.*, 20, 4581-9; Sarver et al., 1990 *Science*, 247, 1222-1225; Thompson et al., 1995, *Nucleic Acids Res.*, 23, 2259; Good et al., 1997, *Gene Therapy*, 4, 45. Transcripts from pol II or pol III promoters are expressed at high levels in all cells; the levels of a given pol II promoter in a given cell type depends on the nature of the gene regulatory sequences (enhancers, silencers, etc.) present nearby. Prokaryotic RNA polymerase promoters are also used, providing that the prokaryotic RNA polymerase enzyme is expressed in the appropriate cells (Elroy-Stein and Moss, 1990, *Proc. Natl. Acad. Sci. USA*, 87, 6743-7; Gao and Huang 1993, *Nucleic Acids Res.*, 21, 2867-72; Lieber et al., 1993, *Methods Enzymol.*, 217, 47-66; Zhou et al., 1990, *Mol. Cell. Biol.*, 10, 4529-37). Several investigators have demonstrated that nucleic acid molecules expressed from such promoters can function in mammalian cells (e.g. Kashani-Sabet et al., 1992, *Antisense Res. Dev.*, 2, 3-15; Ojwang et al., 1992, *Proc. Natl. Acad. Sci. USA*, 89, 10802-6; Chen et al., 1992, *Nucleic Acids Res.*, 20, 4581-9; Yu et al., 1993, *Proc. Natl. Acad. Sci. USA*, 90, 6340-4; L'Huillier et al., 1992, *EMBO J.*, 11, 4411-8; Lisziewicz et al., 1993, *Proc. Natl. Acad. Sci. U.S. A*, 90, 8000-4; Thompson et al., 1995, *Nucleic Acids Res.*, 23, 2259; Sullenger & Cech, 1993, *Science*, 262, 1566). More specifically, transcription units such as the ones derived from genes encoding U6 small nuclear (snRNA), transfer RNA (tRNA) and adenovirus VA RNA are useful in generating high concentrations of desired RNA molecules such as siNA in cells (Thompson et al., supra; Couture and Stinchcomb, 1996, supra; Noonberg et al., 1994, *Nucleic Acid Res.*, 22, 2830; Noonberg et al., U.S. Pat. No. 5,624,803; Good et al., 1997, *Gene Ther.*, 4, 45; Beigelman et al., International PCT Publication No. WO 96/18736. The above siNA transcription units can be incorporated into a variety of vectors for introduction into mammalian cells, including but not restricted to, plasmid DNA vectors, viral DNA vectors (such as adenovirus or adeno-associated virus vectors), or viral RNA vectors (such as retroviral or alphavirus vectors) (for a review see Couture and Stinchcomb, 1996, supra).

Vectors used to express the siNA molecules of the invention can encode one or both strands of an siNA duplex, or a single self-complementary strand that self hybridizes into an siNA duplex. The nucleic acid sequences encoding the siNA molecules of the instant invention can be operably linked in a manner that allows expression of the siNA molecule (see for example Paul et al., 2002, *Nature Biotechnology*, 19, 505; Miyagishi and Taira, 2002, *Nature Biotechnology*, 19, 497; Lee et al., 2002, *Nature Biotechnology*, 19, 500; and Novina et al., 2002, *Nature Medicine, advance online publication* doi:10.1038/nm725).

D. Carrier/Delivery Systems

The siNA molecules of the invention are added directly, or can be complexed with cationic lipids, packaged within liposomes, or as a recombinant plasmid or viral vectors which express the siNA molecules, or otherwise delivered to target cells or tissues. Methods for the delivery of nucleic acid molecules are described in Akhtar et al., 1992, *Trends Cell Bio.*, 2, 139; *Delivery Strategies for Antisense Oligonucleotide Therapeutics*, ed. Akhtar, 1995, Maurer et al., 1999, *Mol. Membr. Biol.*, 16, 129-140; Hofland and Huang, 1999, *Handb. Exp. Pharmacol.*, 137, 165-192; and Lee et al., 2000, *ACS Symp. Ser.*, 752, 184-192. Beigelman et al., U.S. Pat. No. 6,395,713 and Sullivan et al., PCT WO 94/02595 further describe the general methods for delivery of nucleic acid molecules. These protocols can be utilized for the delivery of virtually any nucleic acid molecule. Nucleic acid molecules can be administered to cells by a variety of methods known to those of skill in the art, including, but not restricted to, encapsulation in liposomes, by iontophoresis, or by incorporation into other vehicles, such as biodegradable polymers, hydrogels, cyclodextrins (see for example, Gonzalez et al., 1999, *Bioconjugate Chem.*, 10, 1068-1074; Wang et al., International PCT Publication Nos. WO 03/47518 and WO 03/46185), poly(lactic-co-glycolic)acid (PLGA) and PLCA microspheres (see for example U.S. Pat. No. 6,447,796 and US Patent Application Publication No. US 2002130430), biodegradable nanocapsules, and bioadhesive microspheres, or by proteinaceous vectors (O'Hare and Normand, International PCT Publication No. WO 00/53722).

In one aspect, the present invention provides carrier systems containing the siNA molecules described herein. In some embodiments, the carrier system is a lipid-based carrier system, cationic lipid, or liposome nucleic acid complexes, a liposome, a micelle, a virosome, a lipid nanoparticle or a mixture thereof. In other embodiments, the carrier system is a polymer-based carrier system such as a cationic polymer-nucleic acid complex. In additional embodiments, the carrier system is a cyclodextrin-based carrier system such as a cyclodextrin polymer-nucleic acid complex. In further embodiments, the carrier system is a protein-based carrier system such as a cationic peptide-nucleic acid complex. Preferably, the carrier system is a lipid nanoparticle ("LNP") formulation.

In certain embodiments, the siNA molecules of the invention are formulated with a lipid nanoparticle composition such as is described in U.S. patent application Ser. Nos. 11/353,630, 11/586,102, 61/189,295, 61/204,878, 61/235,476, 61/249,807, 61/298,022, 61/351,373, 61/347,640, 61/345,754, 61/322,054, 12/640,342, and 12/617,079, and PCT Applications Nos. PCT/US10/020,013 and PCT/US09/053,336. In certain preferred embodiments, the siNA molecules of the invention are formulated with a lipid nanoparticle composition comprising a cationic lipid/Cholesterol/PEG-C-DMA/DSPC in a 40/48/2/10 ratio or a cationic lipid/Cholesterol/PEG-DMG/DSPC in a 40/48/2/10 ratio. In more certain embodiments, the cationic lipid is DLinDMA (see Table 12), the PEG is PEG-DMG, and the N/P ratio of the formulation is 2.8. In more preferred embodiments, the cationic lipid is DLinDMA (see Tables 11 & 12).

In various embodiments, lipid nanoparticle formulations described in Table 11 are applied to any siNA molecule or combination of siNA molecules herein. In some embodiments, the invention features a composition comprising an siNA molecule of the invention formulated as any of formulation LNP-051; LNP-053; LNP-054; LNP-069; LNP-073; LNP-077; LNP-080; LNP-082; LNP-083; LNP-060; LNP-061; LNP-086; LNP-097; LNP-098; LNP-099; LNP-100; LNP-101; LNP-102; LNP-103; or LNP-104 (see Table 11).

In certain other embodiments, the invention features a composition comprising an siNA molecule of the invention formulated with any of the cationic lipid formulations described in U.S. Patent Application Nos. 61/189,295, 61/204,878, 61/235,476, 61/249,807, and 61/298,022.

In other embodiments, the invention features conjugates and/or complexes of siNA molecules of the invention. Such conjugates and/or complexes can be used to facilitate delivery of siNA molecules into a biological system, such as a cell. The conjugates and complexes provided by the instant invention can impart therapeutic activity by transferring therapeutic compounds across cellular membranes, altering the pharmacokinetics, and/or modulating the localization of nucleic acid molecules of the invention. Non-limiting, examples of such conjugates are described in U.S. Publication Nos. US2008/0152661 A1 and US 2004/0162260 A1 (e.g., CDM-LBA, CDM-Pip-LBA, CDM-PEG, CDM-NAG, etc.) and U.S. patent application Ser. Nos. 10/427,160 10/201,394, 61/322, 422, and 61/315,223; and U.S. Pat. Nos. 6,528,631; 6,335, 434; 6,235,886; 6,153,737; 5,214,136; and 5,138,045.

In various embodiments, polyethylene glycol (PEG) can be covalently attached to siNA compounds of the present invention. The attached PEG can be any molecular weight, preferably from about 100 to about 50,000 daltons (Da).

In yet other embodiments, the invention features compositions or formulations comprising surface-modified liposomes containing poly(ethylene glycol) lipids (PEG-modified, or long-circulating liposomes or stealth liposomes) and siNA molecules of the invention, such as is disclosed in for example, International PCT Publication No. WO 96/10391; Ansell et al., International PCT Publication No. WO 96/10390; Holland et al., International PCT Publication No. WO 96/10392.

In some embodiments, the siNA molecules of the invention can also be formulated or complexed with polyethyleneimine and derivatives thereof, such as polyethyleneimine-polyethyleneglycol-N-acetylgalactosamine (PEI-PEG-GAL) or polyethylene imine-polyethyleneglycol-tri-N-acetylgalactosamine (PEI-PEG-triGAL) derivatives. In one embodiment, the nucleic acid molecules of the invention are formulated as described in U.S. Patent Application Publication No. 20030077829.

In other embodiments, siNA molecules of the invention are complexed with membrane disruptive agents such as those described in U.S. Patent Application Publication No. 20010007666. In still other embodiments, the membrane disruptive agent or agents and the siNA molecule are also complexed with a cationic lipid or helper lipid molecule, such as those lipids described in U.S. Pat. No. 6,235,310.

In certain embodiments, siNA molecules of the invention are complexed with delivery systems as described in U.S. Patent Application Publication Nos. 2003077829; 20050287551; 20050164220; 20050191627; 20050118594; 20050153919; 20050085486; and 20030158133; and International PCT Publication Nos. WO 00/03683 and WO 02/087541.

In some embodiments, a liposomal formulation of the invention comprises an siNA molecule of the invention (e.g., siNA) formulated or complexed with compounds and compositions described in U.S. Pat. Nos. 6,858,224; 6,534,484; 6,287,591; 6,835,395; 6,586,410; 6,858,225; 6,815,432; 6,586,001; 6,120,798; 6,977,223; 6,998,115; 5,981,501; 5,976,567; 5,705,385; and U.S. Patent Application Publication Nos. 2006/0019912; 2006/0019258; 2006/0008909; 2005/0255153; 2005/0079212; 2005/0008689; 2003/0077829, 2005/0064595, 2005/0175682, 2005/0118253; 2004/0071654; 2005/0244504; 2005/0265961 and 2003/0077829.

Alternatively, recombinant plasmids and viral vectors, as discussed above, which express siNAs of the invention can be used to deliver the molecules of the invention. Delivery of siNA molecule expressing vectors can be systemic, such as by intravenous or intra-muscular administration, by administration to target cells ex-planted from a subject followed by reintroduction into the subject, or by any other means that would allow for introduction into the desired target cell (for a review see Couture et al., 1996, *TIG.*, 12, 510). Such recombinant plasmids can also be administered directly or in conjunction with a suitable delivery reagents, including, for example, the Minis Transit LT1 lipophilic reagent; lipofectin; lipofectamine; cellfectin; polycations (e.g., polylysine) or liposomes lipid-based carrier system, cationic lipid, or liposome nucleic acid complexes, a micelle, a virosome, a lipid nanoparticle.

E. Kits

The present invention also provides nucleic acids in kit form. The kit may comprise a container. The kit typically contains a nucleic acid of the invention with instructions for its administration. In certain instances, the nucleic acids may have a targeting moiety attached. Methods of attaching targeting moieties (e.g. antibodies, proteins) are known to those of skill in the art. In certain instances, the nucleic acids are chemically modified. In other embodiments, the kit contains more than one siNA molecule of the invention. The kits may comprise an siNA molecule of the invention with a pharmaceutically acceptable carrier or diluent. The kits may further comprise excipients.

F. Therapeutic Uses/Pharmaceutical Compositions

The present body of knowledge in CTNNB1 research indicates the need for methods to assay CTNNB1 activity and for compounds that can regulate CTNNB1 expression for research, diagnostic, and therapeutic use. As described infra, the nucleic acid molecules of the present invention can be used in assays to diagnose disease state related of CTNNB1 levels. In addition, the nucleic acid molecules and pharmaceutical compositions can be used to treat disease states related to CTNNB1 RNA levels.

1. Disease States Associated with CTNNB1

Particular disease states that can be associated with CTNNB1 expression modulation include various cancers including solid tumors. Non-limiting examples of such cancers include: bilary tract cancer, bladder cancer, transitional cell carcinoma, urothelial carcinoma, osteosarcoma, brain cancer, gliomas, astrocytomas, breast carcinoma, metaplastic carcinoma, cervical cancer, cervical squamous cell carcinoma, rectal cancer, colorectal carcinoma, colon cancer, hereditary nonpolyposis colorectal cancer, colorectal adenocarcinomas, gastrointestinal stromal tumors (GISTs), endometrial carcinoma, endometrial stromal sarcomas, esophageal cancer, esophageal squamous cell carcinoma, esophageal adenocarcinoma, ocular melanoma, uveal melanoma, gallbladder carcinomas, gallbladder adenocarcinoma, renal cell carcinoma, clear cell renal cell carcinoma, transitional cell carcinoma, urothelial carcinomas, wilms tumor, leukemia, acute lymocytic leukemia (ALL), acute myeloid leukemia (AML), chronic lymphocytic (CLL), chronic myeloid (CML), chronic myelomonocytic (CMML), liver cancer, liver carcinoma, hepatoma, hepatocellular carcinoma, cholangiocarcinoma, hepatoblastoma, Lung cancer, non-small cell lung cancer (NSCLC), mesothelioma, B-cell lymphomas, non-Hodgkin lymphoma, diffuse large B-cell lymphoma, Mantle cell lymphoma, T-cell lymphomas, non-Hodgkin lymphoma, precursor T-lymphoblastic lymphoma/leukemia, peripheral T-cell lymphomas, multiple myeloma, nasopharyngeal carcinoma (NPC), neuroblastoma, oropharyngeal cancer, oral cavity squamous cell carcinomas, osteosarcoma, ovarian carcinoma, pancreatic cancer, pancreatic ductal adenocarcinoma, pseudopapillary neoplasms, acinar cell carcinomas, Prostate cancer, prostate adenocarcinoma, skin cancer, melanoma, malignant melanoma, cutaneous melanoma, small intestine carcinomas, stomach cancer, gastric carcinoma, gastrointestinal stromal tumor (GIST), uterine cancer, and uterine sarcoma.

It is understood that the siNA molecules of the invention can degrade the target CTNNB1 mRNA (and thus inhibit the diseases stated above). Inhibition of a disease can be evaluated by directly measuring the progress of the disease in a subject. It can also be inferred through observing a change or reversal in a condition associated with the disease. Additionally, the siNA molecules of the invention can be used as a prophylaxis. Thus, the use of the nucleic acid molecules and pharmaceutical compositions of the invention can be used to ameliorate, treat, prevent, and/or cure these diseases and others associated with regulation of CTNNB1 gene expression.

2. Pharmaceutical Compositions

The siNA molecules of the instant invention provide useful reagents and methods for a variety of therapeutic, prophylactic, cosmetic, veterinary, diagnostic, target validation, genomic discovery, genetic engineering, and pharmacogenomic applications.

a. Formulations

Thus, the present invention, in one aspect, also provides for pharmaceutical compositions of the siNA molecules described, i.e., compositions in a pharmaceutically acceptable carrier or diluent. These pharmaceutical compositions include salts, esters, or salts of such esters, of the above compounds, e.g., acid addition salts, for example, salts of hydrochloric, hydrobromic, hydroiodic, acetic acid, and benzene sulfonic acid. Other salts include for example, sodium, potassium, manganese, ammonium, and calcium salts. These formulations or compositions can comprise a pharmaceutically acceptable carrier or diluent as is generally known in the art.

In one embodiment, the invention features a pharmaceutical composition comprising an siNA molecule comprising at least a 15 nucleotide sequence of SEQ ID NO: 5. In another embodiment, the invention features a pharmaceutical composition comprising an siNA molecule comprising at least a 15 nucleotide sequence of SEQ ID NO: 4918. In yet another embodiment, the invention features a pharmaceutical composition comprising an siNA molecule comprising at least a 15 nucleotide sequence of SEQ ID NO: 194. In still another embodiment, the invention features a pharmaceutical composition comprising an siNA molecule comprising at least a 15 nucleotide sequence of SEQ ID NO: 5107. In another embodiment, the invention features a pharmaceutical composition comprising an siNA molecule comprising at least a 15 nucleotide sequence of SEQ ID NO: 196. In another embodiment, the invention features a pharmaceutical composition comprising an siNA molecule comprising at least a 15 nucleotide sequence of SEQ ID NO: 5109. In another embodiment, the invention features a pharmaceutical composition comprising an siNA molecule comprising at least a 15 nucleotide sequence of SEQ ID NO: 151. In yet another embodiment, the invention features a pharmaceutical composition comprising an siNA molecule comprising at least a 15 nucleotide sequence of SEQ ID NO: 5064. In still another embodiment, the invention features a pharmaceutical composition comprising an siNA molecule comprising formula (A).

The siNA molecules of the invention are preferably formulated as pharmaceutical compositions prior to administering to a subject, according to techniques known in the art. Pharmaceutical compositions of the present invention are characterized as being at least sterile and pyrogen-free. Methods for preparing pharmaceutical compositions of the invention are within the skill in the art for example as described in *Remington's Pharmaceutical Science,* 17th ed., Mack Publishing Company, Easton, Pa. (1985).

In some embodiments, pharmaceutical compositions of the invention (e.g. siNA and/or LNP formulations thereof) further comprise conventional pharmaceutical excipients and/or additives. Suitable pharmaceutical excipients include preservatives, flavoring agents, stabilizers, antioxidants, osmolality adjusting agents, buffers, and pH adjusting agents. Suitable additives include physiologically biocompatible buffers (e.g., trimethylamine hydrochloride), addition of chelants (such as, for example, DTPA or DTPA-bisamide) or calcium chelate complexes (as for example calcium DTPA, CaNaDTPA-bisamide), or, optionally, additions of calcium or sodium salts (for example, calcium chloride, calcium ascorbate, calcium gluconate or calcium lactate). In addition, antioxidants and suspending agents can be used.

Non-limiting examples of various types of formulations for local administration include ointments, lotions, creams, gels, foams, preparations for delivery by transdermal patches, powders, sprays, aerosols, capsules or cartridges for use in an inhaler or insufflator or drops (for example eye or nose drops), solutions/suspensions for nebulization, suppositories, pessaries, retention enemas and chewable or suckable tablets or pellets (for example for the treatment of aphthous ulcers) or liposome or microencapsulation preparations.

Ointments, creams and gels, can, for example, can be formulated with an aqueous or oily base with the addition of suitable thickening and/or gelling agent and/or solvents. Non limiting examples of such bases can thus, for example, include water and/or an oil such as liquid paraffin or a vegetable oil such as arachis oil or castor oil, or a solvent such as polyethylene glycol. Various thickening agents and gelling agents can be used depending on the nature of the base. Non-limiting examples of such agents include soft paraffin, aluminum stearate, cetostearyl alcohol, polyethylene glycols, woolfat, beeswax, carboxypolymethylene and cellulose derivatives, and/or glyceryl monostearate and/or non-ionic emulsifying agents.

In one embodiment lotions can be formulated with an aqueous or oily base and will in general also contain one or more emulsifying agents, stabilizing agents, dispersing agents, suspending agents or thickening agents.

In one embodiment powders for external application can be formed with the aid of any suitable powder base, for example, talc, lactose or starch. Drops can be formulated with an aqueous or non-aqueous base also comprising one or more dispersing agents, solubilizing agents, suspending agents or preservatives.

Compositions intended for oral use can be prepared according to any method known to the art for the manufacture of pharmaceutical compositions and such compositions can contain one or more such sweetening agents, flavoring agents, coloring agents or preservative agents in order to provide pharmaceutically elegant and palatable preparations. Tablets contain the active ingredient in admixture with non-toxic pharmaceutically acceptable excipients that are suitable for the manufacture of tablets. These excipients can be, for example, inert diluents; such as calcium carbonate, sodium carbonate, lactose, calcium phosphate or sodium phosphate; granulating and disintegrating agents, for example, corn starch, or alginic acid; binding agents, for example starch, gelatin or acacia; and lubricating agents, for example magnesium stearate, stearic acid or talc. The tablets can be uncoated or they can be coated by known techniques. In some cases such coatings can be prepared by known techniques to delay disintegration and absorption in the gastrointestinal tract and thereby provide a sustained action over a longer period. For example, a time delay material such as glyceryl monosterate or glyceryl distearate can be employed.

Formulations for oral use can also be presented as hard gelatin capsules wherein the active ingredient is mixed with an inert solid diluent, for example, calcium carbonate, calcium phosphate or kaolin, or as soft gelatin capsules wherein the active ingredient is mixed with water or an oil medium, for example peanut oil, liquid paraffin or olive oil.

Aqueous suspensions contain the active materials in a mixture with excipients suitable for the manufacture of aqueous suspensions. Such excipients are suspending agents, for example sodium carboxymethylcellulose, methylcellulose, hydropropyl-methylcellulose, sodium alginate, polyvinylpyrrolidone, gum tragacanth and gum acacia; dispersing or wetting agents can be a naturally-occurring phosphatide, for example, lecithin, or condensation products of an alkylene oxide with fatty acids, for example polyoxyethylene stearate; or condensation products of ethylene oxide with long chain aliphatic alcohols, for example heptadecaethyleneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions can also contain one or more preservatives, for example ethyl, or n-propyl p-hydroxybenzoate, one or more coloring agents, one or more flavoring agents, and one or more sweetening agents, such as sucrose or saccharin.

Oily suspensions can be formulated by suspending the active ingredients in a vegetable oil, for example arachis oil, olive oil, sesame oil or coconut oil, or in a mineral oil such as liquid paraffin. The oily suspensions can contain a thickening agent, for example beeswax, hard paraffin or cetyl alcohol. Sweetening agents and flavoring agents can be added to provide palatable oral preparations. These compositions can be preserved by the addition of an anti-oxidant such as ascorbic acid Pharmaceutical compositions of the invention can also be in the form of oil-in-water emulsions. The oily phase can be a vegetable oil or a mineral oil or mixtures of these. Suitable emulsifying agents can be naturally-occurring gums, for example gum acacia or gum tragacanth, naturally-occurring phosphatides, for example soy bean, lecithin, and esters or partial esters derived from fatty acids and hexitol, anhydrides, for example sorbitan monooleate, and condensation products of the said partial esters with ethylene oxide, for example polyoxyethylene sorbitan monooleate. The emulsions can also contain sweetening and flavoring agents.

Syrups and elixirs can be formulated with sweetening agents, for example glycerol, propylene glycol, sorbitol, glucose or sucrose. Such formulations can also contain a demulcent, a preservative and flavoring and coloring agents. The pharmaceutical compositions can be in the form of a sterile injectable aqueous or oleaginous suspension. This suspension can be formulated according to the known art using those suitable dispersing or wetting agents and suspending agents that have been mentioned above. The sterile injectable preparation can also be a sterile injectable solution or suspension in a non-toxic parentally acceptable diluent or solvent, for example as a solution in 1,3-butanediol. Among the acceptable vehicles and solvents that can be employed are water, Ringer's solution and isotonic sodium chloride solution. In addition, sterile, fixed oils are conventionally employed as a solvent or suspending medium. For this purpose, any bland fixed oil can be employed including synthetic mono- or diglycerides. In addition, fatty acids such as oleic acid find use in the preparation of injectables.

The nucleic acid molecules of the invention can also be administered in the form of suppositories, e.g., for rectal administration of the drug. These compositions can be prepared by mixing the drug with a suitable non-irritating excipient that is solid at ordinary temperatures but liquid at the rectal temperature and will therefore melt in the rectum to release the drug. Such materials include cocoa butter and polyethylene glycols.

Nucleic acid molecules of the invention can be administered parenterally in a sterile medium. The drug, depending on the vehicle and concentration used, can either be suspended or dissolved in the vehicle. Advantageously, adjuvants such as local anesthetics, preservatives and buffering agents can be dissolved in the vehicle.

In other embodiments, the siNA and LNP compositions and formulations provided herein for use in pulmonary delivery further comprise one or more surfactants. Suitable surfactants or surfactant components for enhancing the uptake of the compositions of the invention include synthetic and natural as well as full and truncated forms of surfactant protein A, surfactant protein B, surfactant protein C, surfactant protein D and surfactant Protein E, di-saturated phosphatidylcholine (other than dipalmitoyl), dipalmitoylphosphatidylcholine, phosphatidylcholine, phosphatidylglycerol, phosphatidylinositol, phosphatidylethanolamine, phosphatidylserine; phosphatidic acid, ubiquinones, lysophosphatidylethanolamine, lysophosphatidylcholine, palmitoyl-lysophosphatidylcholine, dehydroepiandrosterone, dolichols, sulfatidic acid, glycerol-3-phosphate, dihydroxyacetone phosphate, glycerol, glycero-3-phosphocholine, dihydroxyacetone, palmitate, cytidine diphosphate (CDP) diacylglycerol, CDP choline, choline, choline phosphate; as well as natural and artificial lamellar bodies which are the natural carrier vehicles for the components of surfactant, omega-3 fatty acids, polyenic acid, polyenoic acid, lecithin, palmitinic acid, non-ionic block copolymers of ethylene or propylene oxides, polyoxypropylene, monomeric and polymeric, polyoxyethylene, monomeric and polymeric, poly(vinyl amine) with dextran and/or alkanoyl side chains, Brij 35, Triton X-100 and synthetic surfactants ALEC, Exosurf, Survan and Atovaquone, among others. These surfactants can be used either as single or part of a multiple component surfactant in a formulation, or as covalently bound additions to the 5' and/or 3' ends of the nucleic acid component of a pharmaceutical composition herein.

b. Combinations

The siNAs and pharmaceutical formulations according to the invention can be administered to a subject alone or used in combination with or include one or more other therapeutic agents, for example, anticancer agents. Thus, combinations of the presently disclosed compounds with other anti-cancer or chemotherapeutic agents are within the scope of the invention. Examples of such agents can be found in *Cancer Principles and Practice of Oncology* by V. T. Devita and S. Hellman (editors), 6$^{th}$ edition (Feb. 15, 2001), Lippincott Williams & Wilkins Publishers. A person of ordinary skill in the art would be able to discern which combinations of agents would be useful based on the particular characteristics of the drugs and the cancer involved. Such anti-cancer agents include, but are not limited to, the following: estrogen receptor modulators, androgen receptor modulators, retinoid receptor modulators, cytotoxic/cytostatic agents, antiproliferative agents, prenyl-protein transferase inhibitors, HMG-CoA reductase inhibitors and other angiogenesis inhibitors, inhibitors of cell proliferation and survival signaling, apoptosis inducing agents and agents that interfere with cell cycle checkpoints. The siNAs of the invention are also useful in combination with any therapeutic agent used in the treatment of HCC, for example, but not limitation sorafenib. The instant compounds are particularly useful when co-administered with radiation therapy.

In a further embodiment, therefore, the invention provides a combination comprising an siNA molecule of the invention, such as for example, but not limitation, an siNA molecule comprising at least a 15 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064; or formula (A) or a pharmaceutically acceptable salt, solvate or physiologically functional derivative thereof together with one or more anti-cancer or chemotherapeutic agents.

In certain embodiments, the instant siNA molecules of the invention are useful in combination with known anti-cancer agents including the following: estrogen receptor modulators, androgen receptor modulators, retinoid receptor modulators, cytotoxic agents, antiproliferative agents, prenyl-protein transferase inhibitors, HMG-CoA reductase inhibitors, HIV protease inhibitors, reverse transcriptase inhibitors, and other angiogenesis inhibitors.

Examples of estrogen receptor modulators that can be used in combination with the compounds of the invention include, but are not limited to, tamoxifen, raloxifene, idoxifene, LY353381, LY117081, toremifene, fulvestrant, 4-[7-(2,2-dimethyl-1-oxopropoxy-4-methyl-2-[4-[2-(1-piperidinyl)ethoxy]phenyl]-2H-1-benzopyran-3-yl]-phenyl-2,2-dimethylpropanoate, 4,4'-dihydroxybenzophenone-2,4-dinitrophenyl-hydrazone, and SH646.

Examples of androgen receptor modulators that can be used in combination with the compounds of the invention include, but are not limited to, finasteride and other 5α-reductase inhibitors, nilutamide, flutamide, bicalutamide, liarozole, and abiraterone acetate.

Examples of such retinoid receptor modulators that can be used in combination with the compounds of the invention include, but are not limited to, bexarotene, tretinoin, 13-cis-retinoic acid, 9-cis-retinoic acid, α-difluoromethylornithine, ILX23-7553, trans-N-(4'-hydroxyphenyl)retinamide, and N-4-carboxyphenyl retinamide.

Examples of cytotoxic agents that can be used in combination with the compounds of the invention include, but are not limited to, sertenef, cachectin, ifosfamide, tasonermin, lonidamine, carboplatin, altretamine, prednimustine, dibromodulcitol, ranimustine, fotemustine, nedaplatin, oxaliplatin, temozolomide, heptaplatin, estramustine, improsulfan tosilate, trofosfamide, nimustine, dibrospidium chloride, pumitepa, lobaplatin, satraplatin, profiromycin, cisplatin, irofulven, dexifosfamide, cis-aminedichloro(2-methyl-pyridine)platinum, benzylguanine, glufosfamide, GPX100, (trans, trans, trans)-bis-mu-(hexane-1,6-diamine)-mu-[diamine-platinum(II)]bis[diamine(chloro)platinum (II)]tetrachloride, diarizidinylspermine, arsenic trioxide, 1-(11-dodecylamino-10-hydroxyundecyl)-3,7-dimethylxanthine, zorubicin, idarubicin, daunorubicin, bisantrene, mitoxantrone, pirarubicin, pinafide, valrubicin, amrubicin, antineoplaston, 3'-deamino-3'-morpholino-13-deoxo-10-hydroxycaminomycin, annamycin, galarubicin, elinafide, MEN10755, and 4-demethoxy-3-deamino-3-aziridinyl-4-methylsulphonyl-daunorubicin (see WO 00/50032).

An example of a hypoxia activatable compound that can be used in combination with the compounds of the invention is tirapazamine.

Examples of proteasome inhibitors that can be used in combination with the compounds of the invention include, but are not limited to, lactacystin and bortezomib.

Examples of microtubule inhibitors/microtubule-stabilising agents that can be used in combination with the compounds of the invention include, but are not limited to, paclitaxel, vindesine sulfate, 3',4'-didehydro-4'-deoxy-8'-norvincaleukoblastine, docetaxol, rhizoxin, dolastatin, mivobulin isethionate, auristatin, cemadotin, RPR109881, BMS184476, vinflunine, cryptophycin, 2,3,4,5,6-pentafluoro-N-(3-fluoro-4-methoxyphenyl)benzene sulfonamide, anhydrovinblastine, N,N-dimethyl-L-valyl-L-valyl-N-methyl-L-valyl-L-prolyl-L-proline-t-butylamide, TDX258, the epothilones (see for example U.S. Pat. Nos. 6,284,781 and 6,288,237) and BMS188797.

Some examples of topoisomerase inhibitors that can be used in combination with the compounds of the invention include, but are not limited to, are topotecan, hycaptamine, irinotecan, rubitecan, 6-ethoxypropionyl-3',4'-O-exo-benzylidene-chartreusin, 9-methoxy-N,N-dimethyl-5-nitropyrazolo[3,4,5-kl]acridine-2-(6H) propanamine, 1-amino-9-ethyl-5-fluoro-2,3-dihydro-9-hydroxy-4-methyl-1H,12H-benzo[de]pyrano[3',4':b,7]-indolizino[1,2b]quinoline-10,13(9H,15H)dione, lurtotecan, 7-[2-(N-isopropylamino)ethyl]-(20S)camptothecin, BNP1350, BNPI1100, BN80915, BN80942, etoposide phosphate, teniposide, sobuzoxane, 2'-dimethylamino-2'-deoxy-etoposide, GL331, N-[2-(dimethylamino)ethyl]-9-hydroxy-5,6-dimethyl-6H-pyrido[4,3-b]carbazole-1-carboxamide, asulacrine, (5a, 5 aB, 8aa,9b)-9-[2-[N-[2-(dimethylamino)ethyl]-N-methylamino]ethyl]-5-[4-hydro0xy-3,5-dimethoxyphenyl]-5,5a,6,8,8a,9-hexohydrofuro(3',4':6,7)naphtho(2,3-d)-1,3-dioxol-6-one, 2,3-(methylenedioxy)-5-methyl-7-hydroxy-8-methoxy-benzo[c]-phenanthridinium, 6,9-bis[(2-aminoethyl)amino]benzo[g] isoguinoline-5,10-dione, 5-(3-aminopropylamino)-7,10-dihydroxy-2-(2-hydroxyethylaminomethyl)-6H-pyrazolo[4,5,1-de]acridin-6-one, N-[1-[2(diethylamino)ethylamino]-7-methoxy-9-oxo-9H-thioxanthen-4-ylmethyl]formamide, N-(2-(dimethylamino)ethyl)acridine-4-carboxamide, 6-[[2-(dimethylamino)ethyl]amino]-3-hydroxy-7H-indeno[2,1-c]quinolin-7-one, and dimesna.

Examples of inhibitors of mitotic kinesins, and in particular the human mitotic kinesin KSP, that can be used in combination with the compounds of the invention include, but are not limited to, inhibitors described in PCT Publications WO 01/30768, WO 01/98278, WO 03/050,064, WO 03/050,122, WO 03/049,527, WO 03/049,679, WO 03/049,678, WO04/039774, WO03/079973, WO03/099211, WO03/105855, WO03/106417, WO04/037171, WO04/058148, WO04/058700, WO04/126699, WO05/018638, WO05/019206, WO05/019205, WO05/018547, WO05/017190, US2005/0176776. In an embodiment inhibitors of mitotic kinesins include, but are not limited to inhibitors of KSP, inhibitors of MKLP1, inhibitors of CENP-E, inhibitors of MCAK, inhibitors of Kif14, inhibitors of Mphosph1 and inhibitors of Rab6-KIFL.

Examples of "histone deacetylase inhibitors" that can be used in combination with the compounds of the invention include, but are not limited to, TSA, oxamflatin, PXD101, MG98, valproic acid and scriptaid. Further reference to other histone deacetylase inhibitors may be found in the following manuscript; Miller, T. A. et al. J. Med. Chem. 46(24):5097-5116 (2003).

Inhibitors of kinases involved in mitotic progression that can be used in combination with the compounds of the invention include, but are not limited to, inhibitors of aurora kinase, inhibitors of Polo-like kinases (PLK) (in particular inhibitors of PLK-1), inhibitors of bub-1 and inhibitors of bub-R1.

Antiproliferative agents that can be used in combination with the compounds of the invention include, but are not limited to, antisense RNA and DNA oligonucleotides such as G3139, ODN698, RVASKRAS, GEM231, and INX3001, and antimetabolites such as enocitabine, carmofur, tegafur, pentostatin, doxifluridine, trimetrexate, fludarabine, capecitabine, galocitabine, cytarabine ocfosfate, fosteabine sodium hydrate, raltitrexed, paltitrexid, emitefur, tiazofurin, decitabine, nolatrexed, pemetrexed, nelzarabine, 2'-deoxy-2'-methylidenecytidine, 2'-fluoromethylene-2'-deoxycytidine, N-[5-(2,3-dihydro-benzofuryl)sulfonyl]-N'-(3,4-dichlorophenyl)

urea, N6-[4-deoxy-4-[N2-[2(E),4(E)-tetradecadienoyl] glycylamino]-L-glycero-B-L-manno-heptopyranosyl] adenine, aplidine, ecteinascidin, troxacitabine, 4-[2-amino-4-oxo-4,6,7,8-tetrahydro-3H-pyrimidino[5,4-b][1,4]thiazin-6-yl-(S)-ethyl]-2,5-thienoyl-L-glutamic acid, aminopterin, 5-fluorouracil, alanosine, 11-acetyl-8-(carbamoyloxymethyl)-4-formyl-6-methoxy-14-oxa-1,11-diazatetracyclo (7.4.1.0.0)-tetradeca-2,4,6-trien-9-yl acetic acid ester, swainsonine, lometrexol, dexrazoxane, methioninase, 2'-cyano-2'-deoxy-N4-palmitoyl-1-B-D-arabino furanosyl cytosine and 3-aminopyridine-2-carboxaldehyde thiosemicarbazone.

Examples of monoclonal antibody targeted therapeutic agents that can be used in combination with the compounds of the invention include those therapeutic agents which have cytotoxic agents or radioisotopes attached to a cancer cell specific or target cell specific monoclonal antibody, such as, for example, Bexxar.

Examples of HMG-CoA reductase inhibitors that may be used that can be used in combination with the compounds of the invention include, but are not limited to, lovastatin (MEVACOR®; see U.S. Pat. Nos. 4,231,938, 4,294,926 and 4,319,039), simvastatin (ZOCOR®; see U.S. Pat. Nos. 4,444, 784, 4,820,850 and 4,916,239), pravastatin (PRAVACHOL®; see U.S. Pat. Nos. 4,346,227, 4,537,859, 4,410,629, 5,030,447 and 5,180,589), fluvastatin (LESCOL®; see U.S. Pat. Nos. 5,354,772, 4,911,165, 4,929,437, 5,189,164, 5,118, 853, 5,290,946 and 5,356,896) and atorvastatin (LIPITOR®; see U.S. Pat. Nos. 5,273,995, 4,681,893, 5,489,691 and 5,342,952). The structural formulas of these and additional HMG-CoA reductase inhibitors that may be used in the instant methods are described at page 87 of M. Yalpani, "Cholesterol Lowering Drugs", *Chemistry & Industry*, pp. 85-89 (5 Feb. 1996) and U.S. Pat. Nos. 4,782,084 and 4,885,314.

Examples of prenyl-protein transferase inhibitors that can be used in combination with the compounds of the invention include, but are not limited to, can be found in the following publications and patents: WO 96/30343, WO 97/18813, WO 97/21701, WO 97/23478, WO 97/38665, WO 98/28980, WO 98/29119, WO 95/32987, U.S. Pat. No. 5,420,245, U.S. Pat. No. 5,523,430, U.S. Pat. No. 5,532,359, U.S. Pat. No. 5,510, 510, U.S. Pat. No. 5,589,485, U.S. Pat. No. 5,602,098, European Patent Publ. 0 618 221, European Patent Publ. 0 675 112, European Patent Publ. 0 604 181, European Patent Publ. 0 696 593, WO 94/19357, WO 95/08542, WO 95/11917, WO 95/12612, WO 95/12572, WO 95/10514, U.S. Pat. No. 5,661, 152, WO 95/10515, WO 95/10516, WO 95/24612, WO 95/34535, WO 95/25086, WO 96/05529, WO 96/06138, WO 96/06193, WO 96/16443, WO 96/21701, WO 96/21456, WO 96/22278, WO 96/24611, WO 96/24612, WO 96/05168, WO 96/05169, WO 96/00736, U.S. Pat. No. 5,571,792, WO 96/17861, WO 96/33159, WO 96/34850, WO 96/34851, WO 96/30017, WO 96/30018, WO 96/30362, WO 96/30363, WO 96/31111, WO 96/31477, WO 96/31478, WO 96/31501, WO 97/00252, WO 97/03047, WO 97/03050, WO 97/04785, WO 97/02920, WO 97/17070, WO 97/23478, WO 97/26246, WO 97/30053, WO 97/44350, WO 98/02436, and U.S. Pat. No. 5,532,359. For an example of the role of a prenyl-protein transferase inhibitor on angiogenesis see *European J. of Cancer*, Vol. 35, No. 9, pp. 1394-1401 (1999).

Examples of angiogenesis inhibitors that can be used in combination with the compounds of the invention include, but are not limited to, tyrosine kinase inhibitors, such as inhibitors of the tyrosine kinase receptors Flt-1 (VEGFR1) and Flk-1/KDR (VEGFR2), inhibitors of epidermal-derived, fibroblast-derived, or platelet derived growth factors, MMP (matrix metalloprotease) inhibitors, integrin blockers, interferon-α, interleukin-12, pentosan polysulfate, cyclooxygenase inhibitors, including nonsteroidal anti-inflammatories (NSAIDs) like aspirin and ibuprofen as well as selective cyclooxy-genase-2 inhibitors like celecoxib and rofecoxib (*PNAS*, Vol. 89, p. 7384 (1992); *JNCI*, Vol. 69, p. 475 (1982); *Arch. Opthalmol.*, Vol. 108, p. 573 (1990); *Anat. Rec.*, Vol. 238, p. 68 (1994); *FEBS Letters*, Vol. 372, p. 83 (1995); *Clin, Orthop.* Vol. 313, p. 76 (1995); *J. Mol. Endocrinol.*, Vol. 16, p. 107 (1996); *Jpn. J. Pharmacol.*, Vol. 75, p. 105 (1997); *Cancer Res.*, Vol. 57, p. 1625 (1997); Cell, Vol. 93, p. 705 (1998); *Intl. J. Mol. Med.*, Vol. 2, p. 715 (1998); *J. Biol. Chem.*, Vol. 274, p. 9116 (1999)), steroidal anti-inflammatories (such as corticosteroids, mineralocorticoids, dexamethasone, prednisone, prednisolone, methylpred, betamethasone), carboxyamidotriazole, combretastatin A-4, squalamine, 6-O-chloroacetyl-carbonyl)-fumagillol, thalidomide, angiostatin, troponin-1, angiotensin II antagonists (see Fernandez et al., *J. Lab. Clin. Med.* 105:141-145 (1985)), and antibodies to VEGF (see, *Nature Biotechnology*, Vol. 17, pp. 963-968 (October 1999); Kim et al., *Nature*, 362, 841-844 (1993); WO 00/44777; and WO 00/61186).

Other therapeutic agents that modulate or inhibit angiogenesis may also be used in combination with the compounds of the instant invention and include agents that modulate or inhibit the coagulation and fibrinolysis systems (see review in *Clin. Chem. La. Med.* 38:679-692 (2000)). Examples of such agents that modulate or inhibit the coagulation and fibrinolysis pathways that can be used in combination with the compounds of the invention include, but are not limited to, heparin (see *Thromb. Haemost.* 80:10-23 (1998)), low molecular weight heparins and carboxypeptidase U inhibitors (also known as inhibitors of active thrombin activatable fibrinolysis inhibitor [TAFIa]) (see *Thrombosis Res.* 101:329-354 (2001)). TAFIa inhibitors have been described in PCT Publication WO 03/013,526 and U.S. Ser. No. 60/349,925 (filed Jan. 18, 2002).

Agents that interfere with cell cycle checkpoints that can be used in combination with the compounds of the invention include, but are not limited to, inhibitors of ATR, ATM, the Chk1 and Chk2 kinases and cdkuz and cdc kinase inhibitors and are specifically exemplified by 7-hydroxystaurosporin, flavopiridol, CYC202 (Cyclacel) and BMS-387032.

Agents that interfere with receptor tyrosine kinases (RTKs) that can be used in combination with the compounds of the invention include, but are not limited to, inhibitors of c-Kit, Eph, PDGF, Flt3 and CTNNB1. Further agents include inhibitors of RTKs as described by Bume-Jensen and Hunter, *Nature*, 411:355-365, 2001.

Inhibitors of cell proliferation and survival signaling pathway that can be used in combination with the compounds of the invention include, but are not limited to, inhibitors of EGFR (for example gefitinib and erlotinib), inhibitors of ERB-2 (for example trastuzumab), inhibitors of IGFR, inhibitors of cytokine receptors, inhibitors of CTNNB1, inhibitors of PI3K (for example LY294002), serine/threonine kinases (including but not limited to inhibitors of Akt such as described in WO 02/083064, WO 02/083139, WO 02/083140, US 2004-0116432, WO 02/083138, US 2004-0102360, WO 03/086404, WO 03/086279, WO 03/086394, WO 03/084473, WO 03/086403, WO 2004/041162, WO 2004/096131, WO 2004/096129, WO 2004/096135, WO 2004/096130, WO 2005/100356, WO 2005/100344), inhibitors of Raf kinase (for example BAY-43-9006), inhibitors of MEK (for example CI-1040 and PD-098059) and inhibitors of mTOR (for example Wyeth CCI-779). Such agents include small molecule inhibitor compounds and antibody antagonists.

Apoptosis inducing agents that can be used in combination with the compounds of the invention include, but are not limited to, activators of TNF receptor family members (including the TRAIL receptors).

NSAIDs that are selective COX-2 inhibitors that can be used in combination with the compounds of the invention include, but are not limited to, those NSAIDs disclosed in U.S. Pat. No. 5,474,995, U.S. Pat. No. 5,861,419, U.S. Pat. No. 6,001,843, U.S. Pat. No. 6,020,343, U.S. Pat. No. 5,409,944, U.S. Pat. No. 5,436,265, U.S. Pat. No. 5,536,752, U.S. Pat. No. 5,550,142, U.S. Pat. No. 5,604,260, U.S. Pat. No. 5,698,584, U.S. Pat. No. 5,710,140, WO 94/15932, U.S. Pat. No. 5,344,991, U.S. Pat. No. 5,134,142, U.S. Pat. No. 5,380,738, U.S. Pat. No. 5,393,790, U.S. Pat. No. 5,466,823, U.S. Pat. No. 5,633,272, and U.S. Pat. No. 5,932,598, all of which are hereby incorporated by reference.

Inhibitors of COX-2 that are particularly useful in combination with the compounds of the invention include: 3-phenyl-4-(4-(methylsulfonyl)phenyl)-2-(5H)-furanone; and 5-chloro-3-(4-methylsulfonyl)-phenyl-2-(2-methyl-5-pyridinyl)pyridine; or a pharmaceutically acceptable salt thereof.

Compounds that have been described as specific inhibitors of COX-2 and are therefore useful in the present invention include, but are not limited to: parecoxib, CELEBREX® and BEXTRA® or a pharmaceutically acceptable salt thereof.

Angiogenesis inhibitors that can be used in combination with the compounds of the invention include, but are not limited to, endostatin, ukrain, ranpirnase, IM862, 5-methoxy-4-[2-methyl-3-(3-methyl-2-butenyl)oxiranyl]-1-oxaspiro[2,5]oct-6-yl(chloroacetyl)carbamate, acetyldinanaline, 5-amino-1-[[3,5-dichloro-4-(4-chlorobenzoyl)-phenyl]methyl]-1H-1,2,3-triazole-4-carboxamide, CM101, squalamine, combretastatin, RPI4610, NX31838, sulfated mannopentaose phosphate, 7,7-(carbonyl-bis[imino-N-methyl-4,2-pyrrolocarbonylimino[N-methyl-4,2-pyrrole]-carbonylimino]-bis-(1,3-naphthalene disulfonate), and 3-[(2,4-dimethylpyrrol-5-yl)methylene]-2-indolinone (SU5416).

Tyrosine kinase inhibitors that can be used in combination with the compounds of the invention include, but are not limited to, N-(trifluoromethylphenyl)-5-methylisoxazol-4-carboxamide, 3-[(2,4-dimethylpyrrol-5-yl)methylidenyl)indolin-2-one, 17-(allylamino)-17-demethoxygeldanamycin, 4-(3-chloro-4-fluorophenylamino)-7-methoxy-6-[3-(4-morpholinyl)propoxyl]quinazoline, N-(3-ethynylphenyl)-6,7-bis(2-methoxyethoxy)-4-quinazolinamine, BIBX1382, 2,3,9,10,11,12-hexahydro-10-(hydroxymethyl)-10-hydroxy-9-methyl-9,12-epoxy-1H-diindolo[1,2,3-fg:3',2',1'-kl]pyrrolo[3,4-i][1,6]benzodiazocin-1-one, SH268, genistein, imatinib (STI571), CEP2563, 4-(3-chlorophenylamino)-5,6-dimethyl-7H-pyrrolo[2,3-d]pyrimidinemethane sulfonate, 4-(3-bromo-4-hydroxyphenyl)amino-6,7-dimethoxyquinazoline, 4-(4'-hydroxyphenyl)amino-6,7-dimethoxyquinazoline, SU6668, STI571A, N-4-chlorophenyl-4-(4-pyridylmethyl)-1-phthalazinamine, and EMD121974.

Combinations with compounds other than anti-cancer compounds are also encompassed in the instant compositions and methods. For example, combinations of the instantly claimed compounds with PPAR-γ (i.e., PPAR-gamma) agonists and PPAR-δ (i.e., PPAR-delta) agonists are useful in the treatment of certain malignancies. PPAR-γ and PPAR-δ are the nuclear peroxisome proliferator-activated receptors γ and δ. The expression of PPAR-γ on endothelial cells and its involvement in angiogenesis has been reported in the literature (see *J. Cardiovasc. Pharmacol.* 31:909-913 (1998); *J. Biol. Chem.* 274:9116-9121 (1999); *Invest. Ophthalmol Vis. Sci.* 41:2309-2317 (2000)). More recently, PPAR-γ agonists have been shown to inhibit the angiogenic response to VEGF in vitro; both troglitazone and rosiglitazone maleate inhibit the development of retinal neovascularization in mice. (*Arch. Ophthamol.* 119:709-717 (2001)). Examples of PPAR-γ agonists and PPAR-γ/α agonists that can be used in combination with the compounds of the invention include, but are not limited to, thiazolidinediones (such as DRF2725, CS-011, troglitazone, rosiglitazone, and pioglitazone), fenofibrate, gemfibrozil, clofibrate, GW2570, SB219994, AR-H039242, JTT-501, MCC-555, GW2331, GW409544, NN2344, KRP297, NP0110, DRF4158, NN622, G1262570, PNU182716, DRF552926, 2-[(5,7-dipropyl-3-trifluoromethyl-1,2-benzisoxazol-6-yl)oxy]-2-methylpropionic acid (disclosed in U.S. Ser. No. 09/782,856), and 2(R)-7-(3-(2-chloro-4-(4-fluorophenoxy)phenoxy)propoxy)-2-ethylchromane-2-carboxylic acid (disclosed in U.S. Ser. No. 60/235,708 and 60/244,697).

Another embodiment of the instant invention is the use of the presently disclosed compounds in combination with gene therapy for the treatment of cancer. For an overview of genetic strategies to treating cancer see Hall et al. (*Am J Hum Genet* 61:785-789 (1997)) and Kufe et al. (*Cancer Medicine,* 5th Ed, pp 876-889, BC Decker, Hamilton, 2000). Gene therapy can be used to deliver any tumor suppressing gene. Examples of such genes include, but are not limited to, p53, which can be delivered via recombinant virus-mediated gene transfer (see U.S. Pat. No. 6,069,134, for example), a uPA/uPAR antagonist ("Adenovirus-Mediated Delivery of a uPA/uPAR Antagonist Suppresses Angiogenesis-Dependent Tumor Growth and Dissemination in Mice," *Gene Therapy,* August 5(8):1105-13 (1998)), and interferon gamma (*J Immunol* 164:217-222 (2000)).

The compounds of the instant invention may also be administered in combination with an inhibitor of inherent multidrug resistance (MDR), in particular MDR associated with high levels of expression of transporter proteins. Such MDR inhibitors include inhibitors of p-glycoprotein (P-gp), such as LY335979, XR9576, OC144-093, R101922, VX853 and PSC833 (valspodar).

A compound of the present invention may be employed in conjunction with anti-emetic agents to treat nausea or emesis, including acute, delayed, late-phase, and anticipatory emesis, which may result from the use of a compound of the present invention, alone or with radiation therapy. For the prevention or treatment of emesis, a compound of the present invention may be used in conjunction with other anti-emetic agents, especially neurokinin-1 receptor antagonists, 5HT3 receptor antagonists, such as ondansetron, granisetron, tropisetron, and zatisetron, GABAB receptor agonists, such as baclofen, a corticosteroid such as Decadron (dexamethasone), Kenalog, Aristocort, Nasalide, Preferid, Benecorten or others such as disclosed in U.S. Pat. Nos. 2,789,118, 2,990,401, 3,048,581, 3,126,375, 3,929,768, 3,996,359, 3,928,326 and 3,749,712, an antidopaminergic, such as the phenothiazines (for example prochlorperazine, fluphenazine, thioridazine and mesoridazine), metoclopramide or dronabinol. In an embodiment, an anti-emesis agent selected from a neurokinin-1 receptor antagonist, a 5HT3 receptor antagonist and a corticosteroid is administered as an adjuvant for the treatment or prevention of emesis that may result upon administration of the instant compounds.

Neurokinin-1 receptor antagonists of use in conjunction with the compounds of the present invention are fully described, for example, in U.S. Pat. Nos. 5,162,339, 5,232,929, 5,242,930, 5,373,003, 5,387,595, 5,459,270, 5,494,926, 5,496,833, 5,637,699, 5,719,147; European Patent Publication Nos. EP 0 360 390, 0 394 989, 0 428 434, 0 429 366, 0 430

771, 0 436 334, 0 443 132, 0 482 539, 0 498 069, 0 499 313, 0 512 901, 0 512 902, 0 514 273, 0 514 274, 0 514 275, 0 514 276, 0 515 681, 0 517 589, 0 520 555, 0 522 808, 0 528 495, 0 532 456, 0 533 280, 0 536 817, 0 545 478, 0 558 156, 0 577 394, 0 585 913, 0 590 152, 0 599 538, 0 610 793, 0 634 402, 0 686 629, 0 693 489, 0 694 535, 0 699 655, 0 699 674, 0 707 006, 0 708 101, 0 709 375, 0 709 376, 0 714 891, 0 723 959, 0 733 632 and 0 776 893; PCT International Patent Publication Nos. WO 90/05525, 90/05729, 91/09844, 91/18899, 92/01688, 92/06079, 92/12151, 92/15585, 92/17449, 92/20661, 92/20676, 92/21677, 92/22569, 93/00330, 93/00331, 93/01159, 93/01165, 93/01169, 93/01170, 93/06099, 93/09116, 93/10073, 93/14084, 93/14113, 93/18023, 93/19064, 93/21155, 93/21181, 93/23380, 93/24465, 94/00440, 94/01402, 94/02461, 94/02595, 94/03429, 94/03445, 94/04494, 94/04496, 94/05625, 94/07843, 94/08997, 94/10165, 94/10167, 94/10168, 94/10170, 94/11368, 94/13639, 94/13663, 94/14767, 94/15903, 94/19320, 94/19323, 94/20500, 94/26735, 94/26740, 94/29309, 95/02595, 95/04040, 95/04042, 95/06645, 95/07886, 95/07908, 95/08549, 95/11880, 95/14017, 95/15311, 95/16679, 95/17382, 95/18124, 95/18129, 95/19344, 95/20575, 95/21819, 95/22525, 95/23798, 95/26338, 95/28418, 95/30674, 95/30687, 95/33744, 96/05181, 96/05193, 96/05203, 96/06094, 96/07649, 96/10562, 96/16939, 96/18643, 96/20197, 96/21661, 96/29304, 96/29317, 96/29326, 96/29328, 96/31214, 96/32385, 96/37489, 97/01553, 97/01554, 97/03066, 97/08144, 97/14671, 97/17362, 97/18206, 97/19084, 97/19942 and 97/21702; and in British Patent Publication Nos. 2 266 529, 2 268 931, 2 269 170, 2 269 590, 2 271 774, 2 292 144, 2 293 168, 2 293 169, and 2 302 689. The preparation of such compounds is fully described in the aforementioned patents and publications, which are incorporated herein by reference.

In an embodiment, the neurokinin-1 receptor antagonist for use in conjunction with the compounds of the present invention is selected from: 2-(R)-(1-(R)-(3,5-bis(trifluoromethyl)-phenyl)ethoxy)-3-(S)-(4-fluorophenyl)-4-(3-(5-oxo-1H,4H-1,2,4-triazolo)methyl)morpholine, or a pharmaceutically acceptable salt thereof, which is described in U.S. Pat. No. 5,719,147.

A compound of the instant invention may also be useful for treating or preventing cancer, including bone cancer, in combination with bisphosphonates (understood to include bisphosphonates, diphosphonates, bisphosphonic acids and diphosphonic acids). Examples of bisphosphonates include but are not limited to: etidronate (Didronel), pamidronate (Aredia), alendronate (Fosamax), risedronate (Actonel), zoledronate (Zometa), ibandronate (Boniva), incadronate or cimadronate, clodronate, EB-1053, minodronate, neridronate, piridronate and tiludronate including any and all pharmaceutically acceptable salts, derivatives, hydrates and mixtures thereof.

A compound of the instant invention may also be administered with an agent useful in the treatment of anemia. Such an anemia treatment agent is, for example, a continuous erythropoiesis receptor activator (such as epoetin alfa).

A compound of the instant invention may also be administered with an agent useful in the treatment of neutropenia. Such a neutropenia treatment agent is, for example, a hematopoietic growth factor which regulates the production and function of neutrophils such as a human granulocyte colony stimulating factor, (G-CSF). Examples of a G-CSF include filgrastim and PEG-filgrastim.

A compound of the instant invention may also be administered with an immunologic-enhancing drug, such as levamisole, isoprinosine and Zadaxin.

A compound of the instant invention may also be useful for treating or preventing breast cancer in combination with aromatase inhibitors. Examples of aromatase inhibitors include but are not limited to: anastrozole, letrozole and exemestane.

A compound of the instant invention may also be useful for treating or preventing cancer in combination with other siNA therapeutics.

The compounds of the instant invention may also be administered in combination with γ-secretase inhibitors and/or inhibitors of NOTCH signaling. Such inhibitors include compounds described in WO 01/90084, WO 02/30912, WO 01/70677, WO 03/013506, WO 02/36555, WO 03/093252, WO 03/093264, WO 03/093251, WO 03/093253, WO 2004/039800, WO 2004/039370, WO 2005/030731, WO 2005/014553, U.S. Ser. No. 10/957,251, WO 2004/089911, WO 02/081435, WO 02/081433, WO 03/018543, WO 2004/031137, WO 2004/031139, WO 2004/031138, WO 2004/101538, WO 2004/101539 and WO 02/47671 (including LY-450139).

A compound of the instant invention may also be useful for treating or preventing cancer in combination with PARP inhibitors.

A compound of the instant invention may also be useful for treating cancer in combination with the following therapeutic agents: abarelix (Plenaxis Depot®); aldesleukin (Prokine®); Aldesleukin (Proleukin®); Alemtuzumabb (Campath®); alitretinoin (Panretin); allopurinol (Zyloprim®); altretamine (Hexylen®); amifostine (Ethyol®); anastrozole (Arimidex®); arsenic trioxide (Trisenox®); asparaginase (Elspar®); azacitidine (Vidaza®); bendamustine hydrochloride (Treanda®); bevacuzimab (Avastin®); bexarotene capsules (Targretin®); bexarotene gel (Targretin®); bleomycin (Blenoxane®); bortezomib (Velcade®); brefeldin A; busulfan intravenous (Busulfex®); busulfan oral (Myleran®); calusterone (Methosarb®); capecitabine (Xeloda®); carboplatin (Paraplatin®); carmustine (BCNU®, BiCNU®); carmustine (Gliadel®); carmustine with Polifeprosan 20 Implant (Gliadel Wafer®); celecoxib (Celebrex); cetuximab (Erbitux®); chlorambucil (Leukeran®); cisplatin (Platinol®); cladribine (Leustatin 2-CdA®); clofarabine (Clolar®); cyclophosphamide (Cytoxan®, Neosar®); cyclophosphamide (Cytoxan Injection®); cyclophosphamide (Cytoxan Tablet®); cytarabine (Cytosar-U®); cytarabine liposomal (DepoCyt); dacarbazine (DTIC-Dome®); dactinomycin, actinomycin D (Cosmegen®); dalteparin sodium injection (Fragmin®); Darbepoetin alfa (Aranesp®); dasatinib (Sprycel®); daunorubicin liposomal (DanuoXome®); daunorubicin, daunomycin (Daunorubicin®); daunorubicin, daunomycin (Cerubidine®); degarelix (Firmagon®); Denileukin diftitox (Ontak®); dexrazoxane (Zinecard®); dexrazoxane hydrochloride (Totect®); didemnin B; 17-DMAG; docetaxel (Taxotere®); doxorubicin (Adriamycin PFS®); doxorubicin (Adriamycin®, Rubex®); doxorubicin (Adriamycin PFS Injection®); doxorubicin liposomal (Doxil®); dromostanolone propionate (Dromostanolone®); dromostanolone propionate (Masterone Injection®); eculizumab injection (Soliris®); Elliott's B Solution (Elliott's B Solution®); eltrombopag (Promacta®); epirubicin (Ellence®); Epoetin alfa (Epogen®); erlotinib (Tarceva®); estramustine (Emcyt®); ethinyl estradiol; etoposide phosphate (Etopophos®); etoposide, VP-16 (Vepesid®); everolimus tablets (Afinitor®); exemestane (Aromasin®); ferumoxytol (Feraheme Injection®); Filgrastim (Neupogen®); floxuridine (intraarterial) (FUDR®); fludarabine (Fludara®); fluorouracil, 5-FU (Adrucil®); fulvestrant (Faslodex®); gefitinib (Iressa®); geldanamycin; gemcitabine (Gemzar®); gemtuzumab ozogamicin (Mylotarg®); goserelin acetate (Zoladex Implant®); goserelin acetate (Zoladex®); histrelin acetate (Histrelin Implant®); hydroxyurea (Hydrea®); Ibritumomab Tiuxetan (Zevalin®); idarubicin (Idamycin®); ifosfamide (IFEX®); imatinib mesylate (Gleevec®); interferon alfa 2a (Roferon A®); Interferon alfa-2b (Intron A®); iobenguane 1123 injection (AdreView®); irinotecan (Camptosar®); ixabepilone (Ixempra®); lapatinib tablets (Tykerb®); lenalidomide (Revlimid®); letrozole (Femara®); leucovorin (Wellcovorin®, Leucovorin®); Leuprolide Acetate (Eligard®); levamisole (Ergamisol®); lomustine, CCNU (CeeBU®); meclorethamine, nitrogen mustard (Mustargen®); megestrol acetate (Megace®); melphalan, L-PAM (Alkeran®); mercaptopurine, 6-MP (Purinethol®); mesna (Mesnex®); mesna (Mesnex Tabs®); methotrexate (Methotrexate®); methoxsalen (Uvadex®); 8-methoxypsoralen; mitomycin C (Mutamycin®); mitotane (Lysodren®); mitoxantrone (Novantrone®); mitramycin; nandrolone phenpropionate (Durabolin-50); nelarabine (Arranon®); nilotinib (Tasigna®); Nofetumomab (Verluma®); ofatumumab (Arzerra®); Oprelvekin (Neumega®); oxaliplatin (Eloxatin®); paclitaxel (Paxene®); paclitaxel (Taxol®); paclitaxel protein-bound particles (Abraxane®); palifermin (Kepivance®); pamidronate (Aredia®); panitumumab (Vectibix®); pazopanib tablets (Votrienttm®); pegademase (Adagen (Pegademase Bovine)®); pegaspargase (Oncaspar®); Pegfilgrastim (Neulasta®); pemetrexed disodium (Alimta®); pentostatin (Nipent®); pipobroman (Vercyte®); plerixafor (Mozobil®); plicamycin, mithramycin (Mithracin®); porfimer sodium (Photofrin®); pralatrexate injection (Folotyn®); procarbazine (Matulane®); quinacrine (Atabrine®); rapamycin; Rasburicase (Elitek®); raloxifene hydrochloride (Evista®); Rituximab (Rituxan®); romidepsin (Istodax®); romiplostim (Nplate®); sargramostim (Leukine®); Sargramostim (Prokine); sorafenib (Nexavar); streptozocin (Zanosar®); sunitinib maleate (Sutent); talc (Sclerosol); tamoxifen (Nolvadex); temozolomide (Temodar); temsirolimus (Torisel); teniposide, VM-26 (Vumon®); testolactone (Teslac®); thioguanine, 6-TG (Thioguanine®); thiopurine; thiotepa (Thioplex®); topotecan (Hycamtin®); toremifene (Fareston); Tositumomab (Bexxar); Tositumomab/I-131 tositumomab (Bexxar®); trans-retinoic acid; Trastuzumab (Herceptin®); tretinoin, ATRA (Vesanoid®); triethylenemelamine; Uracil Mustard (Uracil Mustard Capsules®); valrubicin (Valstar®); vinblastine (Velban®); vincristine (Oncovin®); vinorelbine (Navelbine®); vorinostat (Zolinza®); wortmannin; and zoledronate (Zometa®).

The invention also provides a combination comprising an siNA molecule of the invention comprising at least a 15 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064; or formula (A) and/or a pharmaceutically acceptable salt, solvate or physiologically functional derivative thereof together with another CTNNB1 inhibitor.

The combinations referred to above can conveniently be presented for use in the form of a pharmaceutical formulation and thus pharmaceutical compositions comprising a combination as defined above together with a pharmaceutically acceptable diluent or carrier represent a further aspect of the invention.

The individual compounds of such combinations can be administered either sequentially or simultaneously in separate or combined pharmaceutical formulations. In one embodiment, the individual compounds will be administered simultaneously in a combined pharmaceutical formulation.

Thus, the described molecules could be used in combination with one or more known compounds, treatments, or procedures to prevent or treat diseases, disorders, conditions, and traits described herein in a subject or organism as are known in the art, such as other CTNNB1 inhibitors.

3. Therapeutic Applications

The present body of knowledge in CTNNB1 research indicates the need for methods that can regulate CTNNB1 expression for therapeutic use.

Thus, one aspect of the invention comprises a method of treating a subject including, but not limited to, a human suffering from a condition which is mediated by the action, or by loss of action, of CTNNB1 gene expression, which method comprises administering to said subject an effective amount of a double-stranded siNA molecule of the invention. In one embodiment of this aspect, the siNA molecules comprises at least a 15 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064; or formula (A). In another embodiment of this aspect, the condition is or is caused by cancer. Thus, in certain embodiments the molecules and compositions of the instant invention are useful in a method for treating cancer. Cancers treatable according to this aspect of the invention include bilary tract cancer, bladder cancer, transitional cell carcinoma, urothelial carcinoma, osteosarcoma, brain cancer, gliomas, astrocytomas, breast carcinoma, metaplastic carcinoma, cervical cancer, cervical squamous cell carcinoma, rectal cancer, colorectal carcinoma, colon cancer, hereditary nonpolyposis colorectal cancer, colorectal adenocarcinomas, gastrointestinal stromal tumors (GISTs), endometrial carcinoma, endometrial stromal sarcomas, esophageal cancer, esophageal squamous cell carcinoma, esophageal adenocarcinoma, ocular melanoma, uveal melanoma, gallbladder carcinomas, gallbladder adenocarcinoma, renal cell carcinoma, clear cell renal cell carcinoma, transitional cell carcinoma, urothelial carcinomas, wilms tumor, leukemia, acute lymocytic leukemia (ALL), acute myeloid leukemia (AML), chronic lymphocytic (CLL), chronic myeloid (CML), chronic myelomonocytic (CMML), liver cancer, liver carcinoma, hepatoma, hepatocellular carcinoma, cholangiocarcinoma, hepatoblastoma, lung cancer, non-small cell lung cancer (NSCLC), mesothelioma, B-cell lymphomas, non-Hodgkin lymphoma, diffuse large B-cell lymphoma, Mantle cell lymphoma, T-cell lymphomas, non-Hodgkin lymphoma, precursor T-lymphoblastic lymphoma/leukemia, peripheral T-cell lymphomas, multiple myeloma, nasopharyngeal carcinoma (NPC), neuroblastoma, oropharyngeal cancer, oral cavity squamous cell carcinomas, osteosarcoma, ovarian carcinoma, pancreatic cancer, pancreatic ductal adenocarcinoma, pseudopapillary neoplasms, acinar cell carcinomas, prostate cancer, prostate adenocarcinoma, skin cancer, melanoma, malignant melanoma, cutaneous melanoma, small intestine carcinomas, stomach cancer, gastric carcinoma, gastrointestinal stromal tumor (GIST), uterine cancer, uterine sarcoma In one embodiment, the siNA molecules of the instant invention are useful in a method for treating or preventing cancer selected from: brain cancer, breast carcinoma, cervical cancer, colorectal carcinoma, renal cell carcinoma, leukemia, hepatocellular carcinoma, lung cancer, B-cell lymphomas, multiple myeloma, ovarian carcinoma, pancreatic cancer, prostate cancer, melanoma, and gastric carcinoma. In certain embodiments, the compounds of the instant invention are useful for treating breast carcinoma, colorectal carcinoma, hepatocellular carcinoma, lung cancer; and prostate cancer.

In a particular embodiment, the compounds of the instant invention are useful for treating hepatocellular carcinoma.

In another embodiment, the siNA molecules of the instant invention are useful in a method for the prevention or modulation of the metastases of cancer cells and cancer. In particular, the siNA molecules of the instant invention are useful in a method to prevent or modulate the metastases of brain cancer, breast carcinoma, cervical cancer, colorectal carcinoma, renal cell carcinoma, leukemia, hepatocellular carcinoma, lung cancer, B-cell lymphomas, multiple myeloma, ovarian carcinoma, pancreatic cancer, prostate cancer, melanoma, and gastric carcinoma.

In certain embodiments, the administration of the siNA molecule is via local administration or systemic administration. In other embodiments, the invention features contacting the subject or organism with an siNA molecule of the invention via local administration to relevant tissues or cells, such as lung cells and tissues, such as via pulmonary delivery. In yet other embodiments, the invention features contacting the subject or organism with an siNA molecule of the invention via systemic administration (such as via intravenous or subcutaneous administration of siNA) to relevant tissues or cells, such as cancerous tissues or cells in a subject or organism.

siNA molecules of the invention are also used as reagents in ex vivo applications. For example, siNA reagents are introduced into tissue or cells that are transplanted into a subject for therapeutic effect. The cells and/or tissue can be derived from an organism or subject that later receives the explant, or can be derived from another organism or subject prior to transplantation. The siNA molecules can be used to modulate the expression of one or more genes in the cells or tissue, such that the cells or tissue obtain a desired phenotype or are able to perform a function when transplanted in vivo. In one embodiment, certain CTNNB1 target cells from a patient are extracted. These extracted cells are contacted with CTNNB1 siNAs targeting a specific nucleotide sequence within the cells under conditions suitable for uptake of the siNAs by these cells (e.g., using delivery reagents such as cationic lipids, liposomes and the like or using techniques such as electroporation to facilitate the delivery of siNAs into cells). The cells are then reintroduced back into the same patient or other patients.

For therapeutic applications, a pharmaceutically effective dose of the siNA molecules or pharmaceutical compositions of the invention is administered to the subject. A pharmaceutically effective dose is that dose required to prevent, inhibit the occurrence, or treat (alleviate a symptom to some extent, preferably all of the symptoms) a disease state. One skilled in the art can readily determine a therapeutically effective dose of the siNA of the invention to be administered to a given subject, by taking into account factors, such as the size and weight of the subject, the extent of the disease progression or penetration, the age, health, and sex of the subject, the route of administration, and whether the administration is regional or systemic. Generally, an amount between 0.1 µg/kg and 100 mg/kg body weight/day of active ingredients is administered dependent upon potency of the negatively charged polymer. Optimal dosing schedules can be calculated from measurements of drug accumulation in the body of the patient. The siNA molecules of the invention can be administered in a single dose or in multiple doses.

siNA molecules of the instant invention can be administered once monthly, once weekly, once daily (QD), or divided into multiple monthly, weekly, or daily doses, such as, for example, but not limitation, twice daily (BID), three times daily (TID), once every two weeks. Persons of ordinary skill in the art can easily estimate repetition rates for dosing based on measured residence times and concentrations of the drug in bodily fluids or tissues.

In addition, the administration can be continuous, i.e., every day, or intermittently. For example, intermittent administration of a compound of the instant invention may be administration one to six days per week or it may mean administration in cycles (e.g. daily administration for two to eight consecutive weeks, then a rest period with no administration for up to one week) or it may mean administration on alternate days.

G. Administration

Compositions or formulations can be administered in a variety of ways. Non-limiting examples of administration methods of the invention include oral, buccal, sublingual, parenteral (i.e., intraarticularly, intravenously, intraperitoneally, subcutaneously, or intramuscularly), local rectal administration or other local administration. In one embodiment, the composition of the invention can be administered by insufflation and inhalation. Administration can be accomplished via single or divided doses. In some embodiments, the pharmaceutical compositions are administered intravenously or intraperitoneally by a bolus injection (see, e.g., U.S. Pat. No. 5,286,634). Lipid nucleic acid particles can be administered by direct injection at the site of disease or by injection at a site distal from the site of disease (see, e.g., Culver, HUMAN GENE THERAPY, MaryAnn Liebert, Inc., Publishers, New York. pp. 70-71 (1994)). In one embodiment, the siNA molecules of the invention and formulations or compositions thereof are administered to a cell, subject, or organism as is described herein and as is generally known in the art.

1. In Vivo Administration

In any of the methods of treatment of the invention, the siNA can be administered to the subject systemically as described herein or otherwise known in the art, either alone as a monotherapy or in combination with additional therapies described herein or as are known in the art. Systemic administration can include, for example, pulmonary (inhalation, nebulization etc.) intravenous, subcutaneous, intramuscular, catheterization, nasopharangeal, transdermal, or oral/gastrointestinal administration as is generally known in the art.

In any of the methods of treatment or prevention of the invention, the siNA can be administered to the subject locally or to local tissues as described herein or otherwise known in the art, either alone as a monotherapy or in combination with additional therapies as are known in the art. Local administration can include, for example, inhalation, nebulization, catheterization, implantation, direct injection, dermal/transdermal application, patches, stenting, ear/eye drops, or portal vein administration to relevant tissues, or any other local administration technique, method or procedure, as is generally known in the art.

In one embodiment, the siNA molecules of the invention and formulations or compositions thereof are administered to the liver as is generally known in the art (see for example Wen et al., 2004, *World J Gastroenterol.*, 10, 244-9; Murao et al., 2002, *Pharm Res.*, 19, 1808-14; Liu et al., 2003, *gene Ther.*, 10, 180-7; Hong et al., 2003, *J Pharm Pharmacol.*, 54, 51-8; Herrmann et al., 2004, *Arch Virol.*, 149, 1611-7; and Matsuno et al., 2003, *gene Ther.*, 10, 1559-66).

In one embodiment, the invention features the use of methods to deliver the siNA molecules of the instant invention to hematopoietic cells, including monocytes and lymphocytes. These methods are described in detail by Hartmann et al., 1998, *J. Phamacol. Exp. Ther.*, 285(2), 920-928; Kronenwett et al., 1998, *Blood,* 91(3), 852-862; Filion and Phillips, 1997, *Biochim. Biophys. Acta.,* 1329(2), 345-356; Ma and Wei, 1996, *Leuk. Res.,* 20(11/12), 925-930; and Bongartz et al., 1994, *Nucleic Acids Research,* 22(22), 4681-8.

In one embodiment, the siNA molecules of the invention and formulations or compositions thereof are administered directly or topically (e.g., locally) to the dermis or follicles as is generally known in the art (see for example Brand, 2001, *Curr. Opin. Mol. Ther.,* 3, 244-8; Regnier et al., 1998, *J. Drug Target,* 5, 275-89; Kanikkannan, 2002, *BioDrugs,* 16, 339-47; Wraight et al., 2001, *Pharmacol. Ther.,* 90, 89-104; and Preat and Dujardin, 2001, STP PharmaSciences, 11, 57-68). In one embodiment, the siNA molecules of the invention and formulations or compositions thereof are administered directly or topically using a hydroalcoholic gel formulation comprising an alcohol (e.g., ethanol or isopropanol), water, and optionally including additional agents such isopropyl myristate and carbomer 980. In other embodiments, the siNA are formulated to be administered topically to the nasal cavity. Topical preparations can be administered by one or more applications per day to the affected area; over skin areas occlusive dressings can advantageously be used. Continuous or prolonged delivery can be achieved by an adhesive reservoir system.

In one embodiment, an siNA molecule of the invention is administered iontophoretically, for example to a particular organ or compartment (e.g., the eye, back of the eye, heart, liver, kidney, bladder, prostate, tumor, CNS etc.). Non-limiting examples of iontophoretic delivery are described in, for example, WO 03/043689 and WO 03/030989, which are incorporated by reference in their entireties herein.

In one embodiment, the siNA molecules of the invention and formulations or compositions thereof are administered to the lung as is described herein and as is generally known in the art. In another embodiment, the siNA molecules of the invention and formulations or compositions thereof are administered to lung tissues and cells as is described in U.S. Patent Publication Nos. 2006/0062758; 2006/0014289; and 2004/0077540.

2. Aerosols and Delivery Devices
a. Aerosol Formulations

The compositions of the present invention, either alone or in combination with other suitable components, can be made into aerosol formulations (i.e., they can be "nebulized") to be administered via inhalation (e.g., intranasally or intratracheally) (see, Brigham et al., *Am. J. Sci.,* 298:278 (1989)). Aerosol formulations can be placed into pressurized acceptable propellants, such as dichlorodifluoromethane, propane, nitrogen, and the like.

In one embodiment, the siNA molecules of the invention and formulations thereof are administered via pulmonary delivery, such as by inhalation of an aerosol or spray dried formulation administered by an inhalation device or nebulizer, providing rapid local uptake of the nucleic acid molecules into relevant pulmonary tissues. Solid particulate compositions containing respirable dry particles of micronized nucleic acid compositions can be prepared by grinding dried or lyophilized nucleic acid compositions, and then passing the micronized composition through, for example, a 400 mesh screen to break up or separate out large agglomerates. A solid particulate composition comprising the siNA compositions of the invention can optionally contain a dispersant which serves to facilitate the formation of an aerosol as well as other therapeutic compounds. A suitable dispersant is lactose, which can be blended with the nucleic acid compound in any suitable ratio, such as a 1 to 1 ratio by weight.

Spray compositions comprising siNA molecules or compositions of the invention can, for example, be formulated as aqueous solutions or suspensions or as aerosols delivered from pressurized packs, such as a metered dose inhaler, with the use of a suitable liquefied propellant. In one embodiment, aerosol compositions of the invention suitable for inhalation can be either a suspension or a solution and generally contain an siNA molecule comprising at least a 15 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064; or formula (A), and a suitable propellant such as a fluorocarbon or hydrogen-containing chlorofluorocarbon or mixtures thereof, particularly hydrofluoroalkanes, especially 1,1,1,2-tetrafluoroethane, 1,1,1,2,3,3,3-heptafluoro-n-propane or a mixture thereof. The aerosol composition can optionally contain additional formulation excipients well known in the art such as surfactants. Non-limiting examples include oleic acid, lecithin or an oligolactic acid or derivative such as those described in WO94/21229 and WO98/34596 and co-solvents for example ethanol. In one embodiment a pharmaceutical aerosol formulation of the invention comprising a compound of the invention and a fluorocarbon or hydrogen-containing chlorofluorocarbon or mixtures thereof as propellant, optionally in combination with a surfactant and/or a co-solvent.

The aerosol formulations of the invention can be buffered by the addition of suitable buffering agents.

Aerosol formulations can include optional additives including preservatives if the formulation is not prepared sterile. Non-limiting examples include, methyl hydroxybenzoate, anti-oxidants, flavorings, volatile oils, buffering agents and emulsifiers and other formulation surfactants. In one embodiment, fluorocarbon or perfluorocarbon carriers are used to reduce degradation and provide safer biocompatible non-liquid particulate suspension compositions of the invention (e.g., siNA and/or LNP formulations thereof). In another embodiment, a device comprising a nebulizer delivers a composition of the invention (e.g., siNA and/or LNP formulations thereof) comprising fluorochemicals that are bacteriostatic thereby decreasing the potential for microbial growth in compatible devices.

Capsules and cartridges comprising the composition of the invention for use in an inhaler or insufflator, of for example gelatine, can be formulated containing a powder mix for inhalation of a compound of the invention and a suitable powder base such as lactose or starch. In one embodiment, each capsule or cartridge contains an siNA molecule comprising at least a 15 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064; or formula (A), and one or more excipients. In another embodiment, the compound of the invention can be presented without excipients such as lactose The aerosol compositions of the present invention can be administered into the respiratory system as a formulation including particles of respirable size, e.g. particles of a size sufficiently small to pass through the nose, mouth and larynx upon inhalation and through the bronchi and alveoli of the lungs. In general, respirable particles range from about 0.5 to 10 microns in size. In one embodiment, the particulate range can be from 1 to 5 microns. In another embodiment, the particulate range can be from 2 to 3 microns. Particles of non-respirable size which are included in the aerosol tend to deposit in the throat and be swallowed, and the quantity of non-respirable particles in the aerosol is thus minimized. For nasal administration, a particle size in the range of 10-500 um is preferred to ensure retention in the nasal cavity.

In some embodiments, an siNA composition of the invention is administered topically to the nose for example, for the treatment of rhinitis, via pressurized aerosol formulations, aqueous formulations administered to the nose by pressurized pump or by nebulization. Suitable formulations contain water as the diluent or carrier for this purpose. In certain embodiments, the aqueous formulations for administration of the composition of the invention to the lung or nose can be provided with conventional excipients such as buffering agents, tonicity modifying agents and the like.

b. Devices

The siNA molecules of the invention can be formulated and delivered as particles and/or aerosols as discussed above and dispensed from various aerosolization devices known by those of skill in the art.

Aerosols of liquid or non-liquid particles comprising an siNA molecule or formulation of the invention can be produced by any suitable means, such as with a device comprising a nebulizer (see for example U.S. Pat. No. 4,501,729) such as ultrasonic or air jet nebulizers.

Solid particle aerosols comprising an siNA molecule or formulation of the invention and surfactant can be produced with any solid particulate aerosol generator. One type of solid particle aerosol generator used with the siNA molecules of the invention is an insufflator. A second type of illustrative aerosol generator comprises a metered dose inhaler ("MDI"). MDIs containing siNA molecules or formulations taught herein can be prepared by methods of the art (for example, see Byron, above and WO96/32099).

The siNA molecules can also be formulated as a fluid formulation for delivery from a fluid dispenser, such as those described and illustrated in WO05/044354.

In certain embodiments of the invention, nebulizer devices are used in applications for conscious, spontaneously breathing subjects, and for controlled ventilated subjects of all ages. The nebulizer devices can be used for targeted topical and systemic drug delivery to the lung. In one embodiment, a device comprising a nebulizer is used to deliver an siNA molecule or formulation of the invention locally to lung or pulmonary tissues. In another embodiment, a device comprising a nebulizer is used to deliver a an siNA molecule or formulation of the invention systemically.

H. Other Applications/Uses of siNA Molecules of the Invention

The siNA molecules of the invention can also be used for diagnostic applications, research applications, and/or manufacture of medicants.

In one aspect, the invention features a method for diagnosing a disease, trait, or condition in a subject comprising administering to the subject a composition of the invention under conditions suitable for the diagnosis of the disease, trait, or condition in the subject.

In one embodiment, siNA molecules of the invention are used to down regulate or inhibit the expression of CTNNB1 proteins arising from haplotype polymorphisms that are associated with a trait, disease or condition in a subject or organism. Analysis of CTNNB1 genes, or CTNNB1 protein or RNA levels can be used to identify subjects with such polymorphisms or those subjects who are at risk of developing traits, conditions, or diseases described herein. These subjects are amenable to treatment, for example, treatment with siNA molecules of the invention and any other composition useful in treating diseases related to target gene expression. As such, analysis of CTNNB1 protein or RNA levels can be used to determine treatment type and the course of therapy in treating a subject. Monitoring of CTNNB1 protein or RNA levels can be used to predict treatment outcome and to determine the efficacy of compounds and compositions that modulate the level and/or activity of certain CTNNB1 proteins associated with a trait, disorder, condition, or disease.

In another embodiment, the invention comprises use of a double-stranded nucleic acid according to the invention for use in the manufacture of a medicament. In an embodiment, the medicament is for use in treating a condition that is mediated by the action, or by loss of action, of CTNNB1. In one embodiment, the medicament is for use for the treatment of cancer. In an embodiment, the medicament is for use for the treatment of brain cancer, breast carcinoma, cervical cancer, colorectal carcinoma, renal cell carcinoma, leukemia, hepatocellular carcinoma, lung cancer, B-cell lymphomas, multiple myeloma, ovarian carcinoma, pancreatic cancer, prostate cancer, melanoma, and gastric carcinoma. In a particular embodiment, the compounds of the instant invention are useful for treating hepatocellular carcinoma.

In certain embodiments, siNAs wherein at least one strand comprises at least a 15 nucleotide sequence of SEQ ID NO: 5, SEQ ID NO: 4918, SEQ ID NO: 194, SEQ ID NO: 5107, SEQ ID NO: 196, SEQ ID NO: 5109, SEQ ID NO: 151, or SEQ ID NO: 5064; or formula (A), are for use in a method for treating a cancer, such as, for example but not limitation, brain cancer, breast carcinoma, cervical cancer, colorectal carcinoma, renal cell carcinoma, leukemia, hepatocellular carcinoma, lung cancer, B-cell lymphomas, multiple myeloma, ovarian carcinoma, pancreatic cancer, prostate cancer, melanoma, and gastric carcinoma.

I. Examples

The invention will now be illustrated with the following non-limiting examples. Those of skill in the art will readily recognize a variety of non-critical parameters which can be changed or modified to yield essentially the same results.

Example 1

Design, Synthesis, and Identification of siNAs Active Against CTNNB1

CTNNB1 siNA Synthesis

A series of siNA molecules were designed, synthesized and evaluated for efficacy against CTNNB1 gene expression. Certain CTNNB1 sequences were designed and selected by methods set forth in U.S. Application No. 60/182,604. Other sequences were designed and selected using a proprietary algorithm. The primary criteria for design of certain of the CTNNB1 sequences for human siNAs were (i) homology between two species (human and rhesus monkey) and (ii) high efficacy scores as determined by a proprietary algorithm. The effects of the siNAs on CTNNB1 RNA levels. The target sequences of the siNAs that were selected are set forth in Table 1a (target sequences). The sense and antisense strands of the siNA sequences corresponding to the target sequences in Table 1a are set forth in Table 1b. Various chemically modified siNAs that were synthesized are set forth in Table 1c.

TABLE 1a

CTNNB1 Target Sequences, noting human target sites.

| Target Sequence | Target Site (human) | SEQ ID NO: 1 |
|---|---|---|
| UCGAGCUCAGAGGGUACGA | 535 | 1 |
| GAGGCUCUUGUGCGUACUG | 1601 | 2 |
| GCCCAGAAUGCAGUUCGCC | 1709 | 3 |
| CGAGCUCAGAGGGUACGAG | 536 | 4 |
| CUGUUGGAUUGAUUCGAAA | 1797 | 5 |
| GUCUGCUAUUGUACGUACC | 853 | 6 |
| AAUUCUUGGCUAUUACGAC | 1143 | 7 |
| GGAUGUUCACAACCGAAUU | 2014 | 8 |
| ACAGUAUGCAAUGACUCGA | 520 | 9 |
| AGCUUCCAGACACGCUAUC | 814 | 10 |
| UGUCUGCUAUUGUACGUAC | 852 | 11 |
| ACUGUUGGAUUGAUUCGAA | 1796 | 12 |
| CAGGAUACCCAGCGCCGUA | 1901 | 13 |
| GACACGCUAUCAUGCGUUC | 822 | 14 |
| UACUGUUGGAUUGAUUCGA | 1795 | 15 |
| UUCUUGGCUAUUACGACAG | 1145 | 16 |
| ACACGCUAUCAUGCGUUCU | 823 | 17 |
| CAGACACGCUAUCAUGCGU | 820 | 18 |
| UGUUGGAUUGAUUCGAAAU | 1798 | 19 |
| CAGAUCCAAGUCAACGUCU | 1380 | 20 |
| AGGCUCUUGUGCGUACUGU | 1602 | 21 |
| GCGUACUGUCCUUCGGGCU | 1612 | 22 |
| ACUAAUGUCCAGCGUUUGG | 626 | 23 |
| CACAUCCUAGCUCGGGAUG | 2000 | 24 |
| GUUGCUGAGAGGGCUCGAG | 2665 | 25 |
| CAUCUGACCAGCCGACACC | 1676 | 26 |
| UGCGUACUGUCCUUCGGGC | 1611 | 27 |
| ACAAGAUUACAAGAAACGG | 2269 | 28 |
| GUUGUAAACUUGAUUAACU | 674 | 29 |
| UAAACUUGAUUAACUAUCA | 678 | 30 |
| AUAUAAUGAGGACCUAUAC | 1245 | 31 |
| AAACUUGAUUAACUAUCAA | 679 | 32 |
| GAAAUAGUUGAAGGUUGUA | 1970 | 33 |
| AUAAUGAGGACCUAUACUU | 1247 | 34 |
| UUAAAUUCUUGGCUAUUAC | 1140 | 35 |
| UGUAAACUUGAUUAACUAU | 676 | 36 |
| GUAAACUUGAUUAACUAUC | 677 | 37 |
| UUGUAAACUUGAUUAACUA | 675 | 38 |
| GCUUUAGUAAAUAUAAUGA | 1235 | 39 |
| UGGCCACCACCCUGGUGCU | 2488 | 40 |
| CUUUAGUAAAUAUAAUGAG | 1236 | 41 |
| UUUAGUAAAUAUAAUGAGG | 1237 | 42 |
| GUAAAUCGUCCUUUAGGUA | 2555 | 43 |
| ACCUCACUUGCAAUAAUUA | 1545 | 44 |
| UACCAUUCCAUUGUUUGUG | 2050 | 45 |
| UCCAAAGAGUAGCUGCAGG | 2097 | 46 |
| UAUCCAGUUGAUGGGCUGC | 2510 | 47 |
| CAUGCAGAAUACAAAUGAU | 871 | 48 |
| CCAAAGAGUAGCUGCAGGG | 2098 | 49 |
| CACCAUCCCACUGGCCUCU | 1767 | 50 |
| ACCAUGCAGAAUACAAAUG | 869 | 51 |
| AAGACAUCACUGAGCCUGC | 1641 | 52 |
| AAUCAGCUGGCCUGGUUUG | 2582 | 53 |
| AACCUCACUUGCAAUAAUU | 1544 | 54 |
| ACCUCAUGGAUGGGCUGCC | 2550 | 55 |
| ACCAUUCCAUUGUUUGUGC | 2051 | 56 |
| CCAUGCAGAAUACAAAUGA | 870 | 57 |
| CUUCGUCAUCUGACCAGCC | 1670 | 58 |
| CUGUGAACUUGCUCAGGAC | 2122 | 59 |
| AGACAUCACUGAGCCUGCC | 1642 | 60 |
| GAGCCAAUGGCUUGGAAUG | 2324 | 61 |
| ACUGAGCCUGCCAUCUGUG | 1649 | 62 |
| AUUGAAGCUGAGGGAGCCA | 2159 | 63 |
| GUUAUGGUCCAUCAGCUUU | 785 | 64 |
| AAUGUGGUCACCUGUGCAG | 1511 | 65 |
| AGCUGGCCUGGUUUGAUAC | 2586 | 66 |
| UGGCUGAACCAUCACAGAU | 642 | 67 |
| CACCCACCAUCCCACUGGC | 1763 | 68 |
| CAAUGGCUUGGAAUGAGAC | 2328 | 69 |
| UGGACCACAAGCAGAGUGC | 1280 | 70 |
| CCAUUCCAUUGUUUGUGCA | 2052 | 71 |
| CAGGACCUCAUGGAUGGGC | 2546 | 72 |
| GUGAACUUGCUCAGGACAA | 2124 | 73 |
| CCAGGACCUCAUGGAUGGG | 2545 | 74 |
| GGCUGAACCAUCACAGAUG | 643 | 75 |

TABLE 1a-continued

CTNNB1 Target Sequences, noting human target sites.

| Target Sequence | Target Site (human) | SEQ ID NO: 1 |
|---|---|---|
| GGUGCUGACUAUCCAGUUG | 2501 | 76 |
| AUGGCUUGGAAUGAGACUG | 2330 | 77 |
| GGGAAGACAUCACUGAGCC | 1638 | 78 |
| UGGUGACAGGGAAGACAUC | 1630 | 79 |
| UGCUCAUCCCACUAAUGUC | 616 | 80 |
| CUAUCCAGUUGAUGGGCUG | 2509 | 81 |
| GGACCUCAUGGAUGGGCUG | 2548 | 82 |
| CCCACUGGCCUCUGAUAAA | 1773 | 83 |
| UCCGAAUGUCUGAGGACAA | 2247 | 84 |
| UGGCUUGGAAUGAGACUGC | 2331 | 85 |
| UUCAGAUGAUAUAAAUGUG | 1498 | 86 |
| CCACAAGAUUACAAGAAAC | 2267 | 87 |
| CUCACUUGCAAUAAUUAUA | 1547 | 88 |
| CACUUGCAAUAAUUAUAAG | 1549 | 89 |
| GUACCAUGCAGAAUACAAA | 867 | 90 |
| UCAACGUCUUGUUCAGAAC | 1390 | 91 |
| AUCCCAUCUACACAGUUUG | 593 | 92 |
| UACUCAAGCUGAUUUGAUG | 274 | 93 |
| ACCAGGUGGUGGUUAAUAA | 759 | 94 |
| GCUGCAACUAAACAGGAAG | 1439 | 95 |
| UGGAUUGAUUCGAAAUCUU | 1801 | 96 |
| CAGAUGAUAUAAAUGUGGU | 1500 | 97 |
| AUGGUGUCUGCUAUUGUAC | 848 | 98 |
| CACAAGAUUACAAGAAACG | 2268 | 99 |
| CAAAUGAUGUAGAAACAGC | 882 | 100 |
| GCCACAAGAUUACAAGAAA | 2266 | 101 |
| UACAAAUGAUGUAGAAACA | 880 | 102 |
| UCGAAAUCUUGCCCUUUGU | 1810 | 103 |
| GAUUAACUAUCAAGAUGAU | 685 | 104 |
| CCAGUGGAUUCUGUGUUGU | 1007 | 105 |
| AAAGGCUACUGUUGGAUUG | 1789 | 106 |
| ACAAGUAGCUGAUAUUGAU | 499 | 107 |
| GAUGGAACAUGAGAUGGGU | 2470 | 108 |
| UCAAGAUGAUGCAGAACUU | 694 | 109 |
| CAAGCUGAUUUGAUGGAGU | 278 | 110 |
| UGGACUCUCAGGAAUCUUU | 1415 | 111 |
| UAAAUACCAUUCCAUUGUU | 2046 | 112 |
| AUUACAUCAAGAAGGAGCU | 1057 | 113 |
| UCAGGAAUCUUUCAGAUGC | 1422 | 114 |
| UGAUUAACUAUCAAGAUGA | 684 | 115 |
| ACUUCACUCUAGGAAUGAA | 2197 | 116 |
| AACAUGCAGUUGUAAACUU | 666 | 117 |
| AAGCUGAUUUGAUGGAGUU | 279 | 118 |
| UCUGGGUUCAGAUGAUAUA | 1492 | 119 |
| UUACUUCACUCUAGGAAUG | 2195 | 120 |
| AGGAAUCUUUCAGAUGCUG | 1424 | 121 |
| GCUGAAACAUGCAGUUGUA | 661 | 122 |
| GUUGCUUGUUCGUGCACAU | 1882 | 123 |
| GGAAGAAAUAGUUGAAGGU | 1966 | 124 |
| AGGACAAGCCACAAGAUUA | 2259 | 125 |
| CAUGCGUUCUCCUCAGAUG | 832 | 126 |
| GAUGAUCCCAGCUACCGUU | 2346 | 127 |
| AGCCUGCCAUCUGUGCUCU | 1653 | 128 |
| UGGAUAUCGCCAGGAUGAU | 2389 | 129 |
| UCUUCGUCAUCUGACCAGC | 1669 | 130 |
| UGUGAACUUGCUCAGGACA | 2123 | 131 |
| CCUGUGCAGCUGGAAUUCU | 1521 | 132 |
| UGAACUUGCUCAGGACAAG | 2125 | 133 |
| UGCUGACUAUCCAGUUGAU | 2503 | 134 |
| GAUGAUAUAAAUGUGGUCA | 1502 | 135 |
| GUGCUGACUAUCCAGUUGA | 2502 | 136 |
| UGACUAUCCAGUUGAUGGG | 2506 | 137 |
| AACUUGCUCAGGACAAGGA | 2127 | 138 |
| CUGACUAUCCAGUUGAUGG | 2505 | 139 |
| GCUCAUCCCACUAAUGUCC | 617 | 140 |
| GCUGACUAUCCAGUUGAUG | 2504 | 141 |
| AUGAUAUAAAUGUGGUCAC | 1503 | 142 |
| CUCAUCCCACUAAUGUCCA | 618 | 143 |
| GCUUUAUUCUCCCAUUGAA | 2074 | 144 |
| CUGGUGCUGACUAUCCAGU | 2499 | 145 |
| AACUGUCUUUGGACUCUCA | 1406 | 146 |
| AGGGCAUGCAGAUCCCAUC | 582 | 147 |
| GAUAUAAAUGUGGUCACCU | 1505 | 148 |
| UUCAGAUGCUGCAACUAAA | 1432 | 149 |
| AAGAAAUAGUUGAAGGUUG | 1968 | 150 |

TABLE 1a-continued

CTNNB1 Target Sequences, noting human target sites.

| Target Sequence | Target Site (human) | SEQ ID NO: 1 |
|---|---|---|
| CCAGGAUGAUCCUAGCUAU | 2398 | 151 |
| UGGCCAUCUUUAAGUCUGG | 954 | 152 |
| AGCUGAUAUUGAUGGACAG | 505 | 153 |
| UCGGGAUGUUCACAACCGA | 2011 | 154 |
| UGUAGAAGCUGGUGGAAUG | 1339 | 155 |
| UAAAUAUAAUGAGGACCUA | 1242 | 156 |
| CUGAGACAUUAGAUGAGGG | 567 | 157 |
| AGUAAAUAUAAUGAGGACC | 1240 | 158 |
| UGGAUACCUCCCAAGUCCU | 438 | 159 |
| AGGAUGCCUUGGGUAUGGA | 2445 | 160 |
| AUUGUACGUACCAUGCAGA | 860 | 161 |
| UUUGGACUCUCAGGAAUCU | 1413 | 162 |
| UUGGAUUGAUUCGAAAUCU | 1800 | 163 |
| UCAGAGGACUAAAUACCAU | 2037 | 164 |
| CCAGGAUGCCUUGGGUAUG | 2443 | 165 |
| AUGGAACAUGAGAUGGGUG | 2471 | 166 |
| GGCUACUGUUGGAUUGAUU | 1792 | 167 |
| AGGACCUCAUGGAUGGGCU | 2547 | 168 |
| UCUGUGCUCUUCGUCAUCU | 1662 | 169 |
| UGAUGGAGUUGGACAUGGC | 288 | 170 |
| AUGAGGGCAUGCAGAUCCC | 579 | 171 |
| ACUAUCCAGUUGAUGGGCU | 2508 | 172 |
| UGAGGGCAUGCAGAUCCCA | 580 | 173 |
| UUGGAUAUCGCCAGGAUGA | 2388 | 174 |
| GCCCAGGACCUCAUGGAUG | 2543 | 175 |
| AACUUGCCACACGUGCAAU | 708 | 176 |
| CCCAAGUCCUGUAUGAGUG | 447 | 177 |
| CACAGAUGCUGAAACAUGC | 654 | 178 |
| CUGGGACCUUGCAUAACCU | 912 | 179 |
| AGUGGAUUCUGUGUUGUUU | 1009 | 180 |
| AAUGCAAGCUUUAGGACUU | 1354 | 181 |
| AGAAAUAGUUGAAGGUUGU | 1969 | 182 |
| UCCGCAUGGAAGAAAUAGU | 1959 | 183 |
| GCUAUGUUCCCUGAGACAU | 557 | 184 |
| UCUGAGUGGUAAAGGCAAU | 403 | 185 |
| UGCAAGCUUUAGGACUUCA | 1356 | 186 |
| UGGACAGUAUGCAAUGACU | 517 | 187 |
| UUAGUAAAUAUAAUGAGGA | 1238 | 188 |
| CUCAGAUGGUGUCUGCUAU | 843 | 189 |
| AGAACAAGUAGCUGAUAUU | 496 | 190 |
| CUUGGAUAUCGCCAGGAUG | 2387 | 191 |
| CAUCUGUGCUCUUCGUCAU | 1660 | 192 |
| CCCUGGUGCUGACUAUCCA | 2497 | 193 |
| ACGACUAGUUCAGUUGCUU | 1870 | 194 |
| UCUUGGACUUGAUAUUGGU | 2353 | 195 |
| GGAUGAUCCUAGCUAUCGU | 2401 | 196 |
| AAUACAAAUGAUGUAGAAA | 878 | 197 |
| GAACCAUCACAGAUGCUGA | 647 | 198 |
| UUCACAUCCUAGCUCGGGA | 1998 | 199 |
| UGCAGAUCCCAUCUACACA | 588 | 200 |
| GGACUAAAUACCAUUCCAU | 2042 | 201 |
| CUGCUAUUGUACGUACCAU | 855 | 202 |
| CAGAGGACUAAAUACCAUU | 2038 | 203 |
| GAUAAAGGCUACUGUUGGA | 1786 | 204 |
| AGAUGAUAUAAAUGUGGUC | 1501 | 205 |
| AAAUCAUGCACCUUUGCGU | 1834 | 206 |
| ACGACAGACUGCCUUCAAA | 1157 | 207 |
| UAGUAAAUAUAAUGAGGAC | 1239 | 208 |
| UAAUGAGGACCUAUACUUA | 1248 | 209 |
| UGCUGAAACAUGCAGUUGU | 660 | 210 |
| AUUUGAUGGAGUUGGACAU | 285 | 211 |
| CUGCCAAGUGGGUGGUAUA | 1582 | 212 |
| UGGACUACCAGUUGUGGUU | 1735 | 213 |
| UUAAUAAGGCUGCAGUUAU | 771 | 214 |
| ACAUCAAGAAGGAGCUAAA | 1060 | 215 |
| GGAUAUCGCCAGGAUGAUC | 2390 | 216 |
| CUGACAGAGUUACUUCACU | 2186 | 217 |
| GUGACAGGGAAGACAUCAC | 1632 | 218 |
| UCAUCCCACUAAUGUCCAG | 619 | 219 |
| CUGCCAUCUGUGCUCUUCG | 1656 | 220 |
| AUAUAAAUGUGGUCACCUG | 1506 | 221 |
| CCACCCUGGUGCUGACUAU | 2494 | 222 |
| UGCUCUUCGUCAUCUGACC | 1666 | 223 |
| ACAGGGAAGACAUCACUGA | 1635 | 224 |
| AGUUGGACAUGGCCAUGGA | 294 | 225 |

TABLE 1a-continued

CTNNB1 Target Sequences, noting human target sites.

| Target Sequence | Target Site (human) | SEQ ID NO: 1 |
|---|---|---|
| UUGGCUGAACCAUCACAGA | 641 | 226 |
| UAGAUGAGGGCAUGCAGAU | 576 | 227 |
| AGAUGAGGGCAUGCAGAUC | 577 | 228 |
| AUCUGUGCUCUUCGUCAUC | 1661 | 229 |
| GAACUUGCCACACGUGCAA | 707 | 230 |
| CCAUCUGUGCUCUUCGUCA | 1659 | 231 |
| AUGGCAACCAAGAAAGCAA | 1185 | 232 |
| GAAACAUGCAGUUGUAAAC | 664 | 233 |
| UGGUUAAGCUCUUACACCC | 1749 | 234 |
| AGCUUUAGUAAAUAUAAUG | 1234 | 235 |
| CUAUCAAGAUGAUGCAGAA | 691 | 236 |
| AAGUCAACGUCUUGUUCAG | 1387 | 237 |
| GAUCCAAGUCAACGUCUUG | 1382 | 238 |
| CUAUCAUGCGUUCUCCUCA | 828 | 239 |
| AAUAUAAUGAGGACCUAUA | 1244 | 240 |
| GUGCUAUCUGUCUGCUCUA | 1304 | 241 |
| GAAGCUUCCAGACACGCUA | 812 | 242 |
| UAAUUAUAAGAACAAGAUG | 1558 | 243 |
| AUACAAAUGAUGUAGAAAC | 879 | 244 |
| CUGUCUGCUCUAGUAAUAA | 1311 | 245 |
| UGCUAUUGUACGUACCAUG | 856 | 246 |
| UGCUGAAGGUGCUAUCUGU | 1296 | 247 |
| UCUUUAAGUCUGGAGGCAU | 960 | 248 |
| AUACCAUUCCAUUGUUUGU | 2049 | 249 |
| AGGCUACUGUUGGAUUGAU | 1791 | 250 |
| CAGUUAUGGUCCAUCAGCU | 783 | 251 |
| ACAAGAUGAUGGUCUGCCA | 1569 | 252 |
| GACAUAUGCAGCUGCUGUU | 2224 | 253 |
| CCAUCAUCGUGAGGGCUUA | 934 | 254 |
| GACAGAUCCAAGUCAACGU | 1378 | 255 |
| GAGACAUUAGAUGAGGGCA | 569 | 256 |
| UUCGCCUUCACUAUGGACU | 1722 | 257 |
| UGUUCAGCUUCUGGGUUCA | 1483 | 258 |
| AUCUUGGACUUGAUAUUGG | 2352 | 259 |
| CGUGCAAUCCCUGAACUGA | 719 | 260 |
| AGGUGGUGGUUAAUAAGGC | 762 | 261 |
| UCUACACAGUUUGAUGCUG | 599 | 262 |
| AGAUGGCCCAGAAUGCAGU | 1704 | 263 |
| CAAGAUUACAAGAAACGGC | 2270 | 264 |
| CUGAAACAUGCAGUUGUAA | 662 | 265 |
| CUCCUUCUCUGAGUGGUAA | 396 | 266 |
| AGCAAGCUCAUCAUACUGG | 1199 | 267 |
| AUUAUAAGAACAAGAUGAU | 1560 | 268 |
| UCUGUCUGCUCUAGUAAUA | 1310 | 269 |
| AAGCUUUAGUAAAUAUAAU | 1233 | 270 |
| GCCGGCUAUUGUAGAAGCU | 1330 | 271 |
| UGUCUGCUCUAGUAAUAAG | 1312 | 272 |
| AAUAAUUAUAAGAACAAGA | 1556 | 273 |
| UAUGGCCAGGAUGCCUUGG | 2438 | 274 |
| UGUCCCGCAAAUCAUGCAC | 1826 | 275 |
| CUUGUUCAGAACUGUCUUU | 1397 | 276 |
| GCUGUGAUACGAUGCUUCA | 3181 | 277 |
| GCGCCGUACGUCCAUGGGU | 1912 | 278 |
| AGAUGGUGUCUGCUAUUGU | 846 | 279 |
| AGAACUGUCUUUGGACUCU | 1404 | 280 |
| CAUGCAGAUCCCAUCUACA | 586 | 281 |
| CUCCUUGGGACUCUUGUUC | 1469 | 282 |
| GGUGCCACUACCACAGCUC | 380 | 283 |
| AGCUGGUGGAAUGCAAGCU | 1345 | 284 |
| CCAUUCCACGACUAGUUCA | 1863 | 285 |
| CAGCGUUUGGCUGAACCAU | 635 | 286 |
| AUCUUUAAGUCUGGAGGCA | 959 | 287 |
| UGGCCAGGAUGCCUUGGGU | 2440 | 288 |
| GAAUACAAAUGAUGUAGAA | 877 | 289 |
| UGGAUGGGCUGCCUCCAGG | 2556 | 290 |
| CGUACGUCCAUGGGUGGGA | 1916 | 291 |
| GGUGUCUGCUAUUGUACGU | 850 | 292 |
| GGUGCUAUCUGUCUGCUCU | 1303 | 293 |
| CCUUCACUAUGGACUACCA | 1726 | 294 |
| GACUCUUGUUCAGCUUCUG | 1477 | 295 |
| AUCUACACAGUUUGAUGCU | 598 | 296 |
| GUUUGUGCAGCUGCUUUAU | 2062 | 297 |
| CAAGAAACGGCUUUCAGUU | 2278 | 298 |
| GUUCAGUUGCUUGUUCGUG | 1877 | 299 |
| UCAGAUGAUAUAAAUGUGG | 1499 | 300 |

TABLE 1a-continued

CTNNB1 Target Sequences, noting human target sites.

| Target Sequence | Target Site (human) | SEQ ID NO: 1 |
|---|---|---|
| AAUGUUAAAUUCUUGGCUA | 1136 | 301 |
| UGGGUUCAGAUGAUAUAAA | 1494 | 302 |
| AAUAGUUGAAGGUUGUACC | 1972 | 303 |
| CAUGCAGUUGUAAACUUGA | 668 | 304 |
| AAUCUGAAUAAAGUGUAAC | 2945 | 305 |
| CACCACCCUGGUGCUGACU | 2492 | 306 |
| GAGUUGGACAUGGCCAUGG | 293 | 307 |
| AUACCCAGCGCCGUACGUC | 1905 | 308 |
| GAGGGCUUACUGGCCAUCU | 944 | 309 |
| GAGGGCAUGCAGAUCCCAU | 581 | 310 |
| GAAGGGAUGGAAGGUCUCC | 1454 | 311 |
| GUCUGAGGACAAGCCACAA | 2254 | 312 |
| UCAUGCACCUUUGCGUGAG | 1837 | 313 |
| GGAAUCUUUCAGAUGCUGC | 1425 | 314 |
| UCACCUGACAGAUCCAAGU | 1372 | 315 |
| CUGAAGGUGCUAUCUGUCU | 1298 | 316 |
| GUCAUCUGACCAGCCGACA | 1674 | 317 |
| CAUUCCACGACUAGUUCAG | 1864 | 318 |
| UGAUCCUAGCUAUCGUUCU | 2404 | 319 |
| GAGCCCUUCACAUCCUAGC | 1992 | 320 |
| GAUGAGGGCAUGCAGAUCC | 578 | 321 |
| AUGGGUAGGGUAAAUCAGU | 3091 | 322 |
| GUGCAAUCCCUGAACUGAC | 720 | 323 |
| AUUCCAUUGUUUGUGCAGC | 2054 | 324 |
| CAUUCUGGUGCCACUACCA | 374 | 325 |
| UACCAUGCAGAAUACAAAU | 868 | 326 |
| AUGCAGUUCGCCUUCACUA | 1716 | 327 |
| UUACUGGCCAUCUUUAAGU | 950 | 328 |
| GCUUCUGGGUUCAGAUGAU | 1489 | 329 |
| CAGGAAGGGAUGGAAGGUC | 1451 | 330 |
| GCUUAUGGCAACCAAGAAA | 1181 | 331 |
| UGACAGGGAAGACAUCACU | 1633 | 332 |
| AUCGCCAGGAUGAUCCUAG | 2394 | 333 |
| AGUAAUAAGCCGGCUAUUG | 1322 | 334 |
| AAUGAUGUAGAAACAGCUC | 884 | 335 |
| UCUGAGGACAAGCCACAAG | 2255 | 336 |
| GGUCUCCUUGGGACUCUUG | 1466 | 337 |
| UGUUCAGAACUGUCUUUGG | 1399 | 338 |
| CUGGUGCCACUACCACAGC | 378 | 339 |
| GUCCAUGGGUGGGACACAG | 1921 | 340 |
| GUGCGUUUAGCUGGUGGGC | 1085 | 341 |
| ACGUACCAUGCAGAAUACA | 865 | 342 |
| GAUGUUCACAACCGAAUUG | 2015 | 343 |
| AGAAAGCAAGCUCAUCAUA | 1195 | 344 |
| GUUCAGCUUCUGGGUUCAG | 1484 | 345 |
| GCAGGGUGCCAUUCCACGA | 1855 | 346 |
| UAGAAGCUGGUGGAAUGCA | 1341 | 347 |
| CAUGGAAGAAAUAGUUGAA | 1963 | 348 |
| UGAUAUUGGUGCCCAGGGA | 2362 | 349 |
| GGCAUGCAGAUCCCAUCUA | 584 | 350 |
| CGUACUGUCCUUCGGGCUG | 1613 | 351 |
| UUACGACAGACUGCCUUCA | 1155 | 352 |
| UAGUCACUGGCAGCAACAG | 334 | 353 |
| GCCAUUACAACUCUCCACA | 1031 | 354 |
| GCCUUCACUAUGGACUACC | 1725 | 355 |
| GUUCACAACCGAAUUGUUA | 2018 | 356 |
| GGGACCUUGCAUAACCUUU | 914 | 357 |
| AAGCCACAAGAUUACAAGA | 2264 | 358 |
| GCAGCAACAGUCUUACCUG | 343 | 359 |
| UAUUACAUCAAGAAGGAGC | 1056 | 360 |
| UAAUAAGGCUGCAGUUAUG | 772 | 361 |
| GGUGGUGGUUAAUAAGGCU | 763 | 362 |
| UAAUGUCCAGCGUUUGGCU | 628 | 363 |
| CUUCUCUGAGUGGUAAAGG | 399 | 364 |
| ACCAGCCGACACCAAGAAG | 1682 | 365 |
| AUACCUCCCAAGUCCUGUA | 441 | 366 |
| UCACUAUGGACUACCAGUU | 1729 | 367 |
| AGGAUACCCAGCGCCGUAC | 1902 | 368 |
| AGGGAAGACAUCACUGAGC | 1637 | 369 |
| GAUAUCGCCAGGAUGAUCC | 2391 | 370 |
| AAGUAGCUGAUAUUGAUGG | 501 | 371 |
| CAAGCUUUAGGACUUCACC | 1358 | 372 |
| CCCUUUGUCCCGCAAAUCA | 1821 | 373 |
| UUAGAUGAGGGCAUGCAGA | 575 | 374 |
| CAAUGACUCGAGCUCAGAG | 528 | 375 |

TABLE 1a-continued

CTNNB1 Target Sequences, noting human target sites.

| Target Sequence | Target Site (human) | SEQ ID NO: 1 |
|---|---|---|
| GUGGAUAUGGCCAGGAUGC | 2433 | 376 |
| GUUCAGAUGAUAUAAAUGU | 1497 | 377 |
| UCAGGACAAGGAAGCUGCA | 2134 | 378 |
| UUGAAGCUGAGGGAGCCAC | 2160 | 379 |
| UGGAGUUGGACAUGGCCAU | 291 | 380 |
| AGAUGCUGAAACAUGCAGU | 657 | 381 |
| UGAUGGUCUGCCAAGUGGG | 1575 | 382 |
| ACAUGCAGUUGUAAACUUG | 667 | 383 |
| CAGAGUUACUUCACUCUAG | 2190 | 384 |
| GACUCGAGCUCAGAGGGUA | 532 | 385 |
| CUGGCCAUCUUUAAGUCUG | 953 | 386 |
| UACGAUGCUUCAAGAGAAA | 3188 | 387 |
| UGACCAGCUCUCUCUUCAG | 2301 | 388 |
| CUCUCUUCAGAACAGAGCC | 2310 | 389 |
| GCUUUCAGUUGAGCUGACC | 2287 | 390 |
| GGGUGGGACACAGCAGCAA | 1927 | 391 |
| UGCCACACGUGCAAUCCCU | 712 | 392 |
| UCUGUGAACUUGCUCAGGA | 2121 | 393 |
| UGAGUAAUGGUGUAGAACA | 2898 | 394 |
| GUUGGAUUGAUUCGAAAUC | 1799 | 395 |
| UACAACUCUCCACAACCUU | 1036 | 396 |
| CAAGUCCUGUAUGAGUGGG | 449 | 397 |
| AGGAAGGGAUGGAAGGUCU | 1452 | 398 |
| AGCUCAUCAUACUGGCUAG | 1203 | 399 |
| GCAAGCUUUAGGACUUCAC | 1357 | 400 |
| AUGUGGUCACCUGUGCAGC | 1512 | 401 |
| ACUCAAGCUGAUUUGAUGG | 275 | 402 |
| GACAUGGCCAUGGAACCAG | 299 | 403 |
| GUAAAUAUAAUGAGGACCU | 1241 | 404 |
| CGCAUGGAAGAAAUAGUUG | 1961 | 405 |
| GAUGCUGCAACUAAACAGG | 1436 | 406 |
| UGAUGGAACAUGAGAUGGG | 2469 | 407 |
| CCAGGUGGUGGUUAAUAAG | 760 | 408 |
| UGAGGACAAGCCACAAGAU | 2257 | 409 |
| ACUGGCCAUCUUUAAGUCU | 952 | 410 |
| AACGGCUUUCAGUUGAGCU | 2283 | 411 |
| CUACUGUUGGAUUGAUUCG | 1794 | 412 |
| GUUGUGGUUAAGCUCUUAC | 1745 | 413 |
| AUACUGGCUAGUGGUGGAC | 1211 | 414 |
| GACCUCAUGGAUGGGCUGC | 2549 | 415 |
| UAGCUCGGGAUGUUCACAA | 2007 | 416 |
| GAACAUGAGAUGGGUGGCC | 2474 | 417 |
| CAGAAUGCAGUUCGCCUUC | 1712 | 418 |
| ACGUCCAUGGGUGGGACAC | 1919 | 419 |
| UGGUUCACCAGUGGAUUCU | 1000 | 420 |
| AUAUCGCCAGGAUGAUCCU | 2392 | 421 |
| AACAGGAAGGGAUGGAAGG | 1449 | 422 |
| GUUGAGCUGACCAGCUCUC | 2294 | 423 |
| AAAUGUUAAAUUCUUGGCU | 1135 | 424 |
| GGCUAUUGUAGAAGCUGGU | 1333 | 425 |
| CAGUUGUGGUUAAGCUCUU | 1743 | 426 |
| CUACACAGUUUGAUGCUGC | 600 | 427 |
| UGGAGGCAUUCCUGCCCUG | 970 | 428 |
| GGACAGUUUACCAGUUGCC | 3137 | 429 |
| UCCAUUCUGGUGCCACUAC | 372 | 430 |
| UACACCCACCAUCCCACUG | 1761 | 431 |
| CUGAGCCUGCCAUCUGUGC | 1650 | 432 |
| GAGGCAUUCCUGCCCUGGU | 972 | 433 |
| CUUGGCUAUUACGACAGAC | 1147 | 434 |
| CCCUGAGACAUUAGAUGAG | 565 | 435 |
| AUGCAAUGACUCGAGCUCA | 525 | 436 |
| UAGAGGCUCUUGUGCGUAC | 1599 | 437 |
| UUCACUCUAGGAAUGAAGG | 2199 | 438 |
| GACAAGCCACAAGAUUACA | 2261 | 439 |
| CAGAACUUGCCACACGUGC | 705 | 440 |
| GACCUUGCAUAACCUUUCC | 916 | 441 |
| CACUACCACAGCUCCUUCU | 385 | 442 |
| CUAUUUGGGAUAUGUAUGG | 3076 | 443 |
| UCUUGUUCAGAACUGUCUU | 1396 | 444 |
| GAUGCCUUGGGUAUGGACC | 2447 | 445 |
| UUGUAGAAGCUGGUGGAAU | 1338 | 446 |
| AGGUGUGGCGACAUAUGCA | 2215 | 447 |
| GCAAUCCCUGAACUGACAA | 722 | 448 |
| UGCUCUAGUAAUAAGCCGG | 1316 | 449 |
| CCGACACCAAGAAGCAGAG | 1687 | 450 |

TABLE 1a-continued

CTNNB1 Target Sequences, noting human target sites.

| Target Sequence | Target Site (human) | SEQ ID NO: 1 |
|---|---|---|
| AGAUGAUGCAGAACUUGCC | 697 | 451 |
| UUGAUGGGCUGCCAGAUCU | 2517 | 452 |
| AGCCGACACCAAGAAGCAG | 1685 | 453 |
| UAUGGGUAGGGUAAAUCAG | 3090 | 454 |
| CUCAUCAUACUGGCUAGUG | 1205 | 455 |
| UAUUACGACAGACUGCCUU | 1153 | 456 |
| CAAUCCCUGAACUGACAAA | 723 | 457 |
| UCUCCUUGGGACUCUUGUU | 1468 | 458 |
| GAGAUGGGUGGCCACCACC | 2480 | 459 |
| CAGGGUGCCAUUCCACGAC | 1856 | 460 |
| AGUUACUUCACUCUAGGAA | 2193 | 461 |
| UUGGACUUGAUAUUGGUGC | 2355 | 462 |
| CCCUUCACAUCCUAGCUCG | 1995 | 463 |
| AGACACGCUAUCAUGCGUU | 821 | 464 |
| AAUGCAGUUCGCCUUCACU | 1715 | 465 |
| CUUAUGGCAACCAAGAAAG | 1182 | 466 |
| CUCCCAAGUCCUGUAUGAG | 445 | 467 |
| CUUACACCCACCAUCCCAC | 1759 | 468 |
| UGGAAGGUCUCCUUGGGAC | 1461 | 469 |
| AGCCCUUCACAUCCUAGCU | 1993 | 470 |
| GAUGGGCUGCCUCCAGGUG | 2558 | 471 |
| AGCUUCUGGGUUCAGAUGA | 1488 | 472 |
| GAGCCUGCCAUCUGUGCUC | 1652 | 473 |
| UUAAGUCUGGAGGCAUUCC | 963 | 474 |
| ACCUGUGCAGCUGGAAUUC | 1520 | 475 |
| UCCCGCAAAUCAUGCACCU | 1828 | 476 |
| AAGGUGUGGCGACAUAUGC | 2214 | 477 |
| AGCUAUUGAAGCUGAGGGA | 2155 | 478 |
| GUUAGUCACUGGCAGCAAC | 332 | 479 |
| UUCAGUUGCUUGUUCGUGC | 1878 | 480 |
| GAUGAUGGUCUGCCAAGUG | 1573 | 481 |
| CUAAACAGGAAGGGAUGGA | 1446 | 482 |
| CCACGACUAGUUCAGUUGC | 1868 | 483 |
| ACUAGUUCAGUUGCUUGUU | 1873 | 484 |
| GUUCACCAGUGGAUUCUGU | 1002 | 485 |
| GUGGUAAAGGCAAUCCUGA | 408 | 486 |
| UUGAUGGAGUUGGACAUGG | 287 | 487 |
| ACUUGCUCAGGACAAGGAA | 2128 | 488 |
| CCAGUUGAUGGGCUGCCAG | 2513 | 489 |
| GAAAGCAAGCUCAUCAUAC | 1196 | 490 |
| ACAUUAGAUGAGGGCAUGC | 572 | 491 |
| UCCCACUAAUGUCCAGCGU | 622 | 492 |
| GGCAACCAAGAAAGCAAGC | 1187 | 493 |
| AAAUAGUUGAAGGUUGUAC | 1971 | 494 |
| GGAUAUGUAUGGGUAGGGU | 3083 | 495 |
| UAAUCUGAAUAAAGUGUAA | 2944 | 496 |
| UGCACAUCAGGAUACCCAG | 1894 | 497 |
| GUAAUAAGCCGGCUAUUGU | 1323 | 498 |
| AAGCUCAUCAUACUGGCUA | 1202 | 499 |
| ACGUGCAAUCCCUGAACUG | 718 | 500 |
| AGUUGUGGUUAAGCUCUUA | 1744 | 501 |
| AGGACCAGGUGGUGGUUAA | 756 | 502 |
| GCUCUAGUAAUAAGCCGGC | 1317 | 503 |
| GAUUUGAUGGAGUUGGACA | 284 | 504 |
| UGAUGUAGAAACAGCUCGU | 886 | 505 |
| CUGGUGGAUAUGGCCAGGA | 2430 | 506 |
| CAUCAUACUGGCUAGUGGU | 1207 | 507 |
| GAUCCCAUCUACACAGUUU | 592 | 508 |
| CACGCUAUCAUGCGUUCUC | 824 | 509 |
| GACAGUAUGCAAUGACUCG | 519 | 510 |
| AAGUUGUUGUAACCUGCUG | 3166 | 511 |
| GCUAUUACGACAGACUGCC | 1151 | 512 |
| GCCUCCAGGUGACAGCAAU | 2566 | 513 |
| UCCUGUAUGAGUGGGAACA | 453 | 514 |
| AUGCAGAUCCCAUCUACAC | 587 | 515 |
| UUUCCCAUCAUCGUGAGGG | 930 | 516 |
| CCAAGUGGGUGGUAUAGAG | 1585 | 517 |
| GGACCUUGCAUAACCUUUC | 915 | 518 |
| UCCCAAGUCCUGUAUGAGU | 446 | 519 |
| CACGACUAGUUCAGUUGCU | 1869 | 520 |
| CCGCAUGGAAGAAAUAGUU | 1960 | 521 |
| GGCCCAGAUGCAGUUCGC | 1708 | 522 |
| CCAUGGAACCAGACAGAAA | 306 | 523 |
| GAAACGGCUUUCAGUUGAG | 2281 | 524 |
| GGGAUAUGUAUGGGUAGGG | 3082 | 525 |

TABLE 1a-continued

CTNNB1 Target Sequences, noting human target sites.

| Target Sequence | Target Site (human) | SEQ ID NO: 1 |
|---|---|---|
| UUGGGACUCUUGUUCAGCU | 1473 | 526 |
| UAUGUUCCUGAGACAUUA | 559 | 527 |
| GGACUCUCAGGAAUCUUUC | 1416 | 528 |
| AAGCUGCAGAAGCUAUUGA | 2145 | 529 |
| GCCCUUCACAUCCUAGCUC | 1994 | 530 |
| AGAGAUGGCCCAGAAUGCA | 1702 | 531 |
| GCAAUCCUGAGGAAGAGGA | 417 | 532 |
| CAGGAUGCCUUGGGUAUGG | 2444 | 533 |
| CUGCUAUGUUCCCUGAGAC | 555 | 534 |
| UUCACAACCGAAUUGUUAU | 2019 | 535 |
| AAAGCAAGCUCAUCAUACU | 1197 | 536 |
| AGGCAAUCCUGAGGAAGAG | 415 | 537 |
| UGUUUGUGCAGCUGCUUUA | 2061 | 538 |
| GGAAUGCAAGCUUUAGGAC | 1352 | 539 |
| CCGGCUAUUGUAGAAGCUG | 1331 | 540 |
| AAUAAGCCGGCUAUUGUAG | 1325 | 541 |
| UCAGCUUCUGGGUUCAGAU | 1486 | 542 |
| CCUGUAUGAGUGGGAACAG | 454 | 543 |
| CACUCAAGAACAAGUAGCU | 490 | 544 |
| CCUUCACAUCCUAGCUCGG | 1996 | 545 |
| AUGCACCUUUGCGUGAGCA | 1839 | 546 |
| UGUUCGUGCACAUCAGGAU | 1888 | 547 |
| UCAGUUGCUUGUUCGUGCA | 1879 | 548 |
| CCCGCAAAUCAUGCACCUU | 1829 | 549 |
| GCUGAUUUGAUGGAGUUGG | 281 | 550 |
| AUAGAGGCUCUUGUGCGUA | 1598 | 551 |
| CAGGACAAGGAAGCUGCAG | 2135 | 552 |
| AGCUCUUACACCCACCAUC | 1755 | 553 |
| CAUCACAGAUGCUGAAACA | 651 | 554 |
| CUAUUGUAGAAGCUGGUGG | 1335 | 555 |
| AUGCCCAGGACCUCAUGGA | 2541 | 556 |
| UGACUCGAGCUCAGAGGGU | 531 | 557 |
| AGUUUGAUGCUGCUCAUCC | 606 | 558 |
| UCCUUCGGGCUGGUGACAG | 1620 | 559 |
| AUGAAGGUGUGGCGACAUA | 2211 | 560 |
| AGUUGAGCUGACCAGCUCU | 2293 | 561 |
| CUGUAUGAGUGGGAACAGG | 455 | 562 |
| CUCAGAGGGUACGAGCUGC | 540 | 563 |
| GGCAAUCCUGAGGAAGAGG | 416 | 564 |
| CAUACUGGCUAGUGGUGGA | 1210 | 565 |
| ACAAGCCACAAGAUUACAA | 2262 | 566 |
| GCUCUUGUGCGUACUGUCC | 1604 | 567 |
| AUGUGGAUACCUCCCAAGU | 435 | 568 |
| UUGUUUGUGCAGCUGCUUU | 2060 | 569 |
| ACAUAUGCAGCUGCUGUUU | 2225 | 570 |
| UCAGUCCUUCACUCAAGAA | 481 | 571 |
| ACCUUGCAUAACCUUUCCC | 917 | 572 |
| GGCGACAUAUGCAGCUGCU | 2221 | 573 |
| UGGUGUCUGCUAUUGUACG | 849 | 574 |
| GUUCCCUGAGACAUUAGAU | 562 | 575 |
| AUAAAGGCUACUGUUGGAU | 1787 | 576 |
| GUGCCAUUCCACGACUAGU | 1860 | 577 |
| UGGGUGGUAUAGAGGCUCU | 1590 | 578 |
| GGCCAUCUUUAAGUCUGGA | 955 | 579 |
| UAUUGGUGCCCAGGGAGAA | 2365 | 580 |
| CUCGAGCUCAGAGGGUACG | 534 | 581 |
| AGAACUUGCCACACGUGCA | 706 | 582 |
| UACCAGUUGUGGUUAAGCU | 1740 | 583 |
| CGUUUGGCUGAACCAUCAC | 638 | 584 |
| GCUAUUGUAGAAGCUGGUG | 1334 | 585 |
| GGAGGCAUUCCUGCCCUGG | 971 | 586 |
| ACCACCCUGGUGCUGACUA | 2493 | 587 |
| AAUCUUGCCCUUUGUCCCG | 1814 | 588 |
| CGUUUAGCUGGUGGGCUGC | 1088 | 589 |
| CAGUUGAGCUGACCAGCUC | 2292 | 590 |
| UGAUAUAAAUGUGGUCACC | 1504 | 591 |
| CUGAGUGGUAAAGGCAAUC | 404 | 592 |
| AAGGUGCUAUCUGUCUGCU | 1301 | 593 |
| UCCUAGCUCGGGAUGUUCA | 2004 | 594 |
| UCAAGCUGAUUUGAUGGAG | 277 | 595 |
| CCAGCUCUCUCUUCAGAAC | 2304 | 596 |
| ACAUGGCCAUGGAACCAGA | 300 | 597 |
| UACCCAGCGCCGUACGUCC | 1906 | 598 |
| AUAGUUGAAGGUUGUACCG | 1973 | 599 |
| AGCUUUAGGACUUCACCUG | 1360 | 600 |

TABLE 1a-continued

CTNNB1 Target Sequences, noting human target sites.

| Target Sequence | Target Site (human) | SEQ ID NO: 1 |
|---|---|---|
| ACAUCCAAAGAGUAGCUGC | 2094 | 601 |
| UUGCAUAACCUUUCCCAUC | 920 | 602 |
| UGGCCCAGAAUGCAGUUCG | 1707 | 603 |
| AUUCGAAAUCUUGCCCUUU | 1808 | 604 |
| AUAAGCCGGCUAUUGUAGA | 1326 | 605 |
| CGACAGACUGCCUUCAAAU | 1158 | 606 |
| UGCAGUUAUGGUCCAUCAG | 781 | 607 |
| GUUUGAUGCUGCUCAUCCC | 607 | 608 |
| CUAAUGUCCAGCGUUUGGC | 627 | 609 |
| CAAGUAGCUGAUAUUGAUG | 500 | 610 |
| UCUGACAGAGUUACUUCAC | 2185 | 611 |
| GGUGGUAUAGAGGCUCUUG | 1592 | 612 |
| GACCAGGUGGUGGUUAAUA | 758 | 613 |
| CCUCAUGGAUGGGCUGCCU | 2551 | 614 |
| UGUCUUUGGACUCUCAGGA | 1409 | 615 |
| GAACAAGUAGCUGAUAUUG | 497 | 616 |
| GUGCCACUACCACAGCUCC | 381 | 617 |
| GCACCUUUGCGUGAGCAGG | 1841 | 618 |
| GACUUCACCUGACAGAUCC | 1368 | 619 |
| AAAUACCAUUCCAUUGUUU | 2047 | 620 |
| CUCAAGAACAAGUAGCUGA | 492 | 621 |
| UCCUCUGUGAACUUGCUCA | 2118 | 622 |
| UCUGGAGGCAUUCCUGCCC | 968 | 623 |
| AAGUCUGGAGGCAUUCCUG | 965 | 624 |
| UUGAAGGUUGUACCGGAGC | 1977 | 625 |
| ACAUCCUAGCUCGGGAUGU | 2001 | 626 |
| ACCAAGAAAGCAAGCUCAU | 1191 | 627 |
| UUUGGCUGAACCAUCACAG | 640 | 628 |
| CACACGUGCAAUCCCUGAA | 715 | 629 |
| GCUCAUCAUACUGGCUAGU | 1204 | 630 |
| GGGUAGGGUAAAUCAGUAA | 3093 | 631 |
| UUCACCUGACAGAUCCAAG | 1371 | 632 |
| UGGUAAAGGCAAUCCUGAG | 409 | 633 |
| GAUCCUAGCUAUCGUUCUU | 2405 | 634 |
| UUCGUCAUCUGACCAGCCG | 1671 | 635 |
| AAUCUUUCAGAUGCUGCAA | 1427 | 636 |
| UGCAGUUCGCCUUCACUAU | 1717 | 637 |
| AGGAUGAUCCUAGCUAUCG | 2400 | 638 |
| CAGCUCUCUCUUCAGAACA | 2305 | 639 |
| GGUGGGACACAGCAGCAAU | 1928 | 640 |
| CAGGAUGAUCCUAGCUAUC | 2399 | 641 |
| AGGAAGAGGAUGUGGAUAC | 426 | 642 |
| AUCUGUCUGCUCUAGUAAU | 1309 | 643 |
| UAACCUUUCCCAUCAUCGU | 925 | 644 |
| CUGCUUUAUUCUCCCAUUG | 2072 | 645 |
| AAUUGUAAUCUGAAUAAAG | 2939 | 646 |
| UCUUGUUCAGCUUCUGGGU | 1480 | 647 |
| GUUCGUGCACAUCAGGAUA | 1889 | 648 |
| AUGAUGCAGAACUUGCCAC | 699 | 649 |
| GCUGAUAUUGAUGGACAGU | 506 | 650 |
| GGUUAAGCUCUUACACCCA | 1750 | 651 |
| GCCCUUUGUCCCGCAAAUC | 1820 | 652 |
| UCAGAGGGUACGAGCUGCU | 541 | 653 |
| AAACAUGCAGUUGUAAACU | 665 | 654 |
| CUUGCCCUUUGUCCCGCAA | 1817 | 655 |
| UUACAAGAAACGGCUUUCA | 2275 | 656 |
| CACUCUGGUGGAUAUGGCC | 2426 | 657 |
| CAUCUUUAAGUCUGGAGGC | 958 | 658 |
| UGCCAUCUGUGCUCUUCGU | 1657 | 659 |
| UCUUGGCUAUUACGACAGA | 1146 | 660 |
| AUUUGGAUAUGUAUGGGU | 3078 | 661 |
| CAGUGGAUUCUGUGUUGUU | 1008 | 662 |
| CCUUCGGGCUGGUGACAGG | 1621 | 663 |
| GGACACAGCAGCAAUUUGU | 1932 | 664 |
| CCAGCGCCGUACGUCCAUG | 1909 | 665 |
| AAGAAACGGCUUUCAGUUG | 2279 | 666 |
| AUUAGAUGAGGGCAUGCAG | 574 | 667 |
| ACCAGCUCUCUCUUCAGAA | 2303 | 668 |
| AGUUAUGGUCCAUCAGCUU | 784 | 669 |
| GACUAUCCAGUUGAUGGGC | 2507 | 670 |
| AUGCUUGGUUCACCAGUGG | 995 | 671 |
| CUAGCUCGGGAUGUUCACA | 2006 | 672 |
| CUCUUACACCCACCAUCCC | 1757 | 673 |
| CUUGCUCAGGACAAGGAAG | 2129 | 674 |
| AGAUUACAAGAAACGGCUU | 2272 | 675 |

TABLE 1a-continued

CTNNB1 Target Sequences, noting human target sites.

| Target Sequence | Target Site (human) | SEQ ID NO: 1 |
|---|---|---|
| ACCACAGCUCCUUCUCUGA | 389 | 676 |
| AGAUGCUGCAACUAAACAG | 1435 | 677 |
| UUAAGCUCUUACACCCACC | 1752 | 678 |
| AAUAAGGCUGCAGUUAUGG | 773 | 679 |
| UUGGGAUAUGUAUGGGUAG | 3080 | 680 |
| GUAACCUGCUGUGAUACGA | 3174 | 681 |
| UGGUCUGCCAAGUGGGUGG | 1578 | 682 |
| CCUUCUCUGAGUGGUAAAG | 398 | 683 |
| GAAGCUAUUGAAGCUGAGG | 2153 | 684 |
| AUGCAGAACUUGCCACACG | 702 | 685 |
| GUAGCUGAUAUUGAUGGAC | 503 | 686 |
| CUCAAGCUGAUUUGAUGGA | 276 | 687 |
| GCAUGGAAGAAAUAGUUGA | 1962 | 688 |
| CUGGUGGAAUGCAAGCUUU | 1347 | 689 |
| CCCAGGACCUCAUGGAUGG | 2544 | 690 |
| UUUGGGAUAUGUAUGGGUA | 3079 | 691 |
| CAAAGUUGUUGUAACCUGC | 3164 | 692 |
| CCGAAUUGUUAUCAGAGGA | 2026 | 693 |
| UAAUUGUAAUCUGAAUAAA | 2938 | 694 |
| AUUGUAAUCUGAAUAAAGU | 2940 | 695 |
| CGAAUUGUUAUCAGAGGAC | 2027 | 696 |
| CCAAGUCCUGUAUGAGUGG | 448 | 697 |
| AAGCCGGCUAUUGUAGAAG | 1328 | 698 |
| AUCCUAGCUAUCGUUCUUU | 2406 | 699 |
| AUAACCUUUCCCAUCAUCG | 924 | 700 |
| GCCAAGUGGGUGGUAUAGA | 1584 | 701 |
| CGACUAGUUCAGUUGCUUG | 1871 | 702 |
| UUGGUUCACCAGUGGAUUC | 999 | 703 |
| GUUCAGAACUGUCUUUGGA | 1400 | 704 |
| UGCUGUGAUACGAUGCUUC | 3180 | 705 |
| UCCAGGUGACAGCAAUCAG | 2569 | 706 |
| UAUGGUCCAUCAGCUUUCU | 787 | 707 |
| UGCCAUUCCACGACUAGUU | 1861 | 708 |
| AACCAAGAAAGCAAGCUCA | 1190 | 709 |
| AUAAUUAUAAGAACAAGAU | 1557 | 710 |
| GUUAAGCUCUUACACCCAC | 1751 | 711 |
| UUGAGUAAUGGUGUAGAAC | 2897 | 712 |
| GUGUGGCGACAUAUGCAGC | 2217 | 713 |
| GACCAGCUCUCUCUUCAGA | 2302 | 714 |
| UUGUACCGGAGCCCUUCAC | 1984 | 715 |
| AUGGCCAUGGAACCAGACA | 302 | 716 |
| UGGUGGAUAUGGCCAGGAU | 2431 | 717 |
| CCUCUGACAGAGUUACUUC | 2183 | 718 |
| AUGAUCCUAGCUAUCGUUC | 2403 | 719 |
| AUGGUCCAUCAGCUUUCUA | 788 | 720 |
| GGACUCUUGUUCAGCUUCU | 1476 | 721 |
| GCUAUCAUGCGUUCUCCUC | 827 | 722 |
| GCUGACCAGCUCUCUCUUC | 2299 | 723 |
| UCGUGCACAUCAGGAUACC | 1891 | 724 |
| UACUUCACUCUAGGAAUGA | 2196 | 725 |
| UGAAACAUGCAGUUGUAAA | 663 | 726 |
| UAUGCCAUUACAACUCUCC | 1028 | 727 |
| UGUUAUCAGAGGACUAAAU | 2032 | 728 |
| GAUGGAAGGUCUCCUUGGG | 1459 | 729 |
| CAUCCAAAGAGUAGCUGCA | 2095 | 730 |
| GCCGACACCAAGAAGCAGA | 1686 | 731 |
| CUUUGGACUCUCAGGAAUC | 1412 | 732 |
| GGAACAUGAGAUGGGUGGC | 2473 | 733 |
| UGGCAGUGCGUUUAGCUGG | 1080 | 734 |
| GGAAGCUGCAGAAGCUAUU | 2143 | 735 |
| CUCUAGGAAUGAAGGUGUG | 2203 | 736 |
| GUACGAGCUGCUAUGUUCC | 548 | 737 |
| UCCACGACUAGUUCAGUUG | 1867 | 738 |
| CCUCAGAUGGUGUCUGCUA | 842 | 739 |
| CUCUGUGAACUUGCUCAGG | 2120 | 740 |
| GCAGUUAUGGUCCAUCAGC | 782 | 741 |
| UCUUACACCCACCAUCCCA | 1758 | 742 |
| CGCCAGGAUGAUCCUAGCU | 2396 | 743 |
| CACCUGACAGAUCCAAGUC | 1373 | 744 |
| UCACCUGUGCAGCUGGAAU | 1518 | 745 |
| GGAUGGGCUGCCUCCAGGU | 2557 | 746 |
| UACCGGAGCCCUUCACAUC | 1987 | 747 |
| UGAGACAUUAGAUGAGGGC | 568 | 748 |
| CACUCUAGGAAUGAAGGUG | 2201 | 749 |
| UUGAUGCUGCUCAUCCCAC | 609 | 750 |

TABLE 1a-continued

CTNNB1 Target Sequences, noting human target sites.

| Target Sequence | Target Site (human) | SEQ ID NO: 1 |
|---|---|---|
| UUCUCUGAGUGGUAAAGGC | 400 | 751 |
| UGUUAGUCACUGGCAGCAA | 331 | 752 |
| GAAGAAAUAGUUGAAGGUU | 1967 | 753 |
| CUUCACUCUAGGAAUGAAG | 2198 | 754 |
| CUGGGUUCAGAUGAUAUAA | 1493 | 755 |
| GGACAAGCCACAAGAUUAC | 2260 | 756 |
| ACCCUGGUGCUGACUAUCC | 2496 | 757 |
| UUGAUAUUGGUGCCCAGGG | 2361 | 758 |
| ACCUCCCAAGUCCUGUAUG | 443 | 759 |
| GUAUGCAAUGACUCGAGCU | 523 | 760 |
| CCAGUUGUGGUUAAGCUCU | 1742 | 761 |
| AUGACUCGAGCUCAGAGGG | 530 | 762 |
| UUGUUGUAACCUGCUGUGA | 3169 | 763 |
| CCAAGUCAACGUCUUGUUC | 1385 | 764 |
| AUCAGAGGACUAAAUACCA | 2036 | 765 |
| UGUAUGGGUAGGGUAAAUC | 3088 | 766 |
| CGUGAGCAGGGUGCCAUUC | 1850 | 767 |
| UGAUGGGCUGCCAGAUCUG | 2518 | 768 |
| CUUGUUCGUGCACAUCAGG | 1886 | 769 |
| CCAUCACAGAUGCUGAAAC | 650 | 770 |
| ACAGUUUACCAGUUGCCUU | 3139 | 771 |
| ACCGAAUUGUUAUCAGAGG | 2025 | 772 |
| GCAGUGCGUUUAGCUGGUG | 1082 | 773 |
| AACAUGAGAUGGGUGGCCA | 2475 | 774 |
| CCUGACAGAUCCAAGUCAA | 1375 | 775 |
| GGGAUGUUCACAACCGAAU | 2013 | 776 |
| GGAUUGAUUCGAAAUCUUG | 1802 | 777 |
| GAAGCUGCAGAAGCUAUUG | 2144 | 778 |
| AAUGACUCGAGCUCAGAGG | 529 | 779 |
| UUGUUCAGCUUCUGGGUUC | 1482 | 780 |
| CCUCACUUGCAAUAAUUAU | 1546 | 781 |
| CAGAUGGUGUCUGCUAUUG | 845 | 782 |
| CUUCACUCAAGAACAAGUA | 487 | 783 |
| AUCACAGAUGCUGAAACAU | 652 | 784 |
| AGUUCGCCUUCACUAUGGA | 1720 | 785 |
| UACUGGCCAUCUUUAAGUC | 951 | 786 |
| CAAGCUUUAGUAAAUAUAA | 1232 | 787 |
| AGCCACAAGAUUACAAGAA | 2265 | 788 |
| AAGCAGAGAUGGCCCAGAA | 1698 | 789 |
| GAUGCAGAACUUGCCACAC | 701 | 790 |
| AUCUUUCAGAUGCUGCAAC | 1428 | 791 |
| UGGGACACAGCAGCAAUUU | 1930 | 792 |
| ACAGAUCCAAGUCAACGUC | 1379 | 793 |
| ACAGCAGCAAUUUGUGGAG | 1936 | 794 |
| UGCAACUAAACAGGAAGGG | 1441 | 795 |
| GCUCAGGACAAGGAAGCUG | 2132 | 796 |
| GACUAAAUACCAUUCCAUU | 2043 | 797 |
| UUUGAUGCUGCUCAUCCCA | 608 | 798 |
| UGGCAGCAACAGUCUUACC | 341 | 799 |
| AAGAAAGCAAGCUCAUCAU | 1194 | 800 |
| UGAUCUUGGACUUGAUAUU | 2350 | 801 |
| CUGAAUAAAGUGUAACAAU | 2948 | 802 |
| ACUAAAUACCAUUCCAUUG | 2044 | 803 |
| AUCCCACUAAUGUCCAGCG | 621 | 804 |
| CCACUACCACAGCUCCUUC | 384 | 805 |
| CAUCAGGAUACCCAGCGCC | 1898 | 806 |
| UCACAGAUGCUGAAACAUG | 653 | 807 |
| UUUGCGUGAGCAGGGUGCC | 1846 | 808 |
| GCUGAUCUUGGACUUGAUA | 2348 | 809 |
| GGCUAUUACGACAGACUGC | 1150 | 810 |
| GGACAUGGCCAUGGAACCA | 298 | 811 |
| AACAAGAUGAUGGUCUGCC | 1568 | 812 |
| UUACAUCAAGAAGGAGCUA | 1058 | 813 |
| AAUCAUGCACCUUUGCGUG | 1835 | 814 |
| GCAAAUCAUGCACCUUUGC | 1832 | 815 |
| GAGUGGUAAAGGCAAUCCU | 406 | 816 |
| UCGCCUUCACUAUGGACUA | 1723 | 817 |
| AUCCAUUCUGGUGCCACUA | 371 | 818 |
| AUCAGGAUACCCAGCGCCG | 1899 | 819 |
| AGUAUGCAAUGACUCGAGC | 522 | 820 |
| CGGCUUUCAGUUGAGCUGA | 2285 | 821 |
| GCUGCAGUUAUGGUCCAUC | 779 | 822 |
| AUUGAGUAAUGGUGUAGAA | 2896 | 823 |
| GUAAUCUGAAUAAAGUGUA | 2943 | 824 |
| UUGAUGGACAGUAUGCAAU | 513 | 825 |

TABLE 1a-continued

CTNNB1 Target Sequences, noting human target sites.

| Target Sequence | Target Site (human) | SEQ ID NO: 1 |
|---|---|---|
| GAUAUGUAUGGGUAGGGUA | 3084 | 826 |
| GAACAAGAUGAUGGUCUGC | 1567 | 827 |
| UUAUCAGAGGACUAAAUAC | 2034 | 828 |
| UUCACCAGUGGAUUCUGUG | 1003 | 829 |
| AAGGUUGUACCGGAGCCCU | 1980 | 830 |
| GUAGAAGCUGGUGGAAUGC | 1340 | 831 |
| AUGCUGCAACUAAACAGGA | 1437 | 832 |
| UCACUCUGGUGGAUAUGGC | 2425 | 833 |
| CUGAUUUGAUGGAGUUGGA | 282 | 834 |
| UCAUCAUACUGGCUAGUGG | 1206 | 835 |
| GCUUGUUCGUGCACAUCAG | 1885 | 836 |
| UCUGCUCUAGUAAUAAGCC | 1314 | 837 |
| UAUCUGUCUGCUCUAGUAA | 1308 | 838 |
| GCAAGCUCAUCAUACUGGC | 1200 | 839 |
| AGAGGGUACGAGCUGCUAU | 543 | 840 |
| UGUGCGUACUGUCCUUCGG | 1609 | 841 |
| GGAAGGGAUGGAAGGUCUC | 1453 | 842 |
| AUGCGUUCUCCUCAGAUGG | 833 | 843 |
| GACAGAGUUACUUCACUCU | 2188 | 844 |
| UUGGCUAUUACGACAGACU | 1148 | 845 |
| GGACUACCAGUUGUGGUUA | 1736 | 846 |
| UUCAGAACUGUCUUUGGAC | 1401 | 847 |
| AUCUGACCAGCCGACACCA | 1677 | 848 |
| ACACAGCAGCAAUUUGUGG | 1934 | 849 |
| UACCACAGCUCCUUCUCUG | 388 | 850 |
| CGUCCAUGGGUGGGACACA | 1920 | 851 |
| UGUGGUUAAGCUCUUACAC | 1747 | 852 |
| UUGUACGUACCAUGCAGAA | 861 | 853 |
| GAUACCCAGCGCCGUACGU | 1904 | 854 |
| UCAUGCGUUCUCCUCAGAU | 831 | 855 |
| GCACAUCAGGAUACCCAGC | 1895 | 856 |
| GAUUACAAGAAACGGCUUU | 2273 | 857 |
| ACUACCAGUUGUGGUUAAG | 1738 | 858 |
| GUCUUGUUCAGAACUGUCU | 1395 | 859 |
| UCAUCUGACCAGCCGACAC | 1675 | 860 |
| CUUUGCGUGAGCAGGGUGC | 1845 | 861 |
| CUGUCUUUGGACUCUCAGG | 1408 | 862 |
| UACAUCAAGAAGGAGCUAA | 1059 | 863 |
| AGAUCCAAGUCAACGUCUU | 1381 | 864 |
| CAAGUCAACGUCUUGUUCA | 1386 | 865 |
| UCCUUGGGACUCUUGUUCA | 1470 | 866 |
| GGUGGAAUGCAAGCUUUAG | 1349 | 867 |
| CUGCAACUAAACAGGAAGG | 1440 | 868 |
| UUAGGACUUCACCUGACAG | 1364 | 869 |
| AGUAGCUGAUAUUGAUGGA | 502 | 870 |
| UAUAAUGAGGACCUAUACU | 1246 | 871 |
| CCUGCUGUGAUACGAUGCU | 3178 | 872 |
| AUGGGUGGCCACCACCCUG | 2483 | 873 |
| GACUCUCAGGAAUCUUUCA | 1417 | 874 |
| GUGCACAUCAGGAUACCCA | 1893 | 875 |
| UUCCAGACACGCUAUCAUG | 817 | 876 |
| UUGCCACACGUGCAAUCCC | 711 | 877 |
| UCAGAUGCUGCAACUAAAC | 1433 | 878 |
| CUUUAGGACUUCACCUGAC | 1362 | 879 |
| CAUGCACCUUUGCGUGAGC | 1838 | 880 |
| ACAACUCUCCACAACCUUU | 1037 | 881 |
| UGGGACUCUUGUUCAGCUU | 1474 | 882 |
| GCUUGGUUCACCAGUGGAU | 997 | 883 |
| UUCCCAUCAUCGUGAGGGC | 931 | 884 |
| GUCUGCUCUAGUAAUAAGC | 1313 | 885 |
| CAGCUUCGGGUUCAGAUG | 1487 | 886 |
| CGUCAUCUGACCAGCCGAC | 1673 | 887 |
| UGUUCCCUGAGACAUUAGA | 561 | 888 |
| GCAACCAAGAAAGCAAGCU | 1188 | 889 |
| GGAGUUGGACAUGGCCAUG | 292 | 890 |
| GUCCGCAUGGAAGAAAUAG | 1958 | 891 |
| CUGAUCUUGGACUUGAUAU | 2349 | 892 |
| AUGGAAGGUCUCCUUGGGA | 1460 | 893 |
| GAUGGUCUGCCAAGUGGGU | 1576 | 894 |
| ACUAUCAAGAUGAUGCAGA | 690 | 895 |
| ACAGAUGCUGAAACAUGCA | 655 | 896 |
| UUCAGUUGAGCUGACCAGC | 2290 | 897 |
| AGAGGCUCUUGUGCGUACU | 1600 | 898 |
| GGUGGAUAUGGCCAGGAUG | 2432 | 899 |
| CUUGCCACACGUGCAAUCC | 710 | 900 |

TABLE 1a-continued

CTNNB1 Target Sequences, noting human target sites.

| Target Sequence | Target Site (human) | SEQ ID NO: 1 |
|---|---|---|
| GAAUGCAGUUCGCCUUCAC | 1714 | 901 |
| CCUAGCUCGGGAUGUUCAC | 2005 | 902 |
| UUCACUAUGGACUACCAGU | 1728 | 903 |
| GAUGGGUGGCCACCACCCU | 2482 | 904 |
| UGGUUAAUAAGGCUGCAGU | 768 | 905 |
| AUCAAGAUGAUGCAGAACU | 693 | 906 |
| CUGCUGUGAUACGAUGCUU | 3179 | 907 |
| AUGCCUUGGGUAUGGACCC | 2448 | 908 |
| UGUGAUACGAUGCUUCAAG | 3183 | 909 |
| GAGUGCUGAAGGUGCUAUC | 1293 | 910 |
| GAGGGUACGAGCUGCUAUG | 544 | 911 |
| UUAAUUGUAAUCUGAAUAA | 2937 | 912 |
| CACCAAGAAGCAGAGAUGG | 1691 | 913 |
| GAAUGCAAGCUUUAGGACU | 1353 | 914 |
| ACCUUUGCGUGAGCAGGGU | 1843 | 915 |
| AGGUGCUAUCUGUCUGCUC | 1302 | 916 |
| UUGCUCAGGACAAGGAAGC | 2130 | 917 |
| GCUGAGGGAGCCACAGCUC | 2165 | 918 |
| CUACCACAGCUCCUUCUCU | 387 | 919 |
| UGGAACAUGAGAUGGGUGG | 2472 | 920 |
| GCUAUUGUACGUACCAUGC | 857 | 921 |
| UCUUGCCCUUUGUCCCGCA | 1816 | 922 |
| UUAUAAGAACAAGAUGAUG | 1561 | 923 |
| GGAAGCUUCCAGACACGCU | 811 | 924 |
| UAAGCCGGCUAUUGUAGAA | 1327 | 925 |
| GGACCAGGUGGUGGUUAAU | 757 | 926 |
| CUGAUAUUGAUGGACAGUA | 507 | 927 |
| UGGGUAGGGUAAAUCAGUA | 3092 | 928 |
| ACUUGAUAUUGGUGCCCAG | 2359 | 929 |
| UAAGCUCUUACACCCACCA | 1753 | 930 |
| CUACUCAAGCUGAUUUGAU | 273 | 931 |
| GGUGCCAUUCCACGACUAG | 1859 | 932 |
| UUGGACAUGGCCAUGGAAC | 296 | 933 |
| CUGCUCAUCCCACUAAUGU | 615 | 934 |
| CAUGGCCAUGGAACCAGAC | 301 | 935 |
| UAUGGCAACCAAGAAAGCA | 1184 | 936 |
| ACCAGUGGAUUCUGUGUUG | 1006 | 937 |
| ACAGAGUUACUUCACUCUA | 2189 | 938 |
| UAGGACUUCACCUGACAGA | 1365 | 939 |
| GCCAGGAUGCCUUGGGUAU | 2442 | 940 |
| AAUGAGGACCUAUACUUAC | 1249 | 941 |
| AUUCUUGGCUAUUACGACA | 1144 | 942 |
| CUUUAUUCUCCCAUUGAAA | 2075 | 943 |
| UAGCUGAUAUUGAUGGACA | 504 | 944 |
| GAACUGUCUUUGGACUCUC | 1405 | 945 |
| UUAGUCACUGGCAGCAACA | 333 | 946 |
| CCAUUACAACUCUCCACAA | 1032 | 947 |
| GUGGUUAAGCUCUUACACC | 1748 | 948 |
| UGAUUUGAUGGAGUUGGAC | 283 | 949 |
| GCAGAGAUGGCCCAGAAUG | 1700 | 950 |
| ACUAAACAGGAAGGGAUGG | 1445 | 951 |
| ACAAAUGUUAAAUUCUUGG | 1133 | 952 |
| GCAAUGACUCGAGCUCAGA | 527 | 953 |
| CUCGGGAUGUUCACAACCG | 2010 | 954 |
| GUGUCUGCUAUUGUACGUA | 851 | 955 |
| UGUGGAUACCUCCCAAGUC | 436 | 956 |
| GGAUGCCUUGGGUAUGGAC | 2446 | 957 |
| AAAUUCUUGGCUAUUACGA | 1142 | 958 |
| UACGAGCUGCUAUGUUCCC | 549 | 959 |
| CAGUGCGUUUAGCUGGUGG | 1083 | 960 |
| CAAGAUGAUGCAGAACUUG | 695 | 961 |
| AUGAUGUAGAAACAGCUCG | 885 | 962 |
| UGCAGCUGCUUUAUUCUCC | 2067 | 963 |
| CCACAGCUCCUUCUCUGAG | 390 | 964 |
| CAGUUCGCCUUCACUAUGG | 1719 | 965 |
| AAGCUUCCAGACACGCUAU | 813 | 966 |
| UUUCAGUUGAGCUGACCAG | 2289 | 967 |
| UCUGGUGCCACUACCACAG | 377 | 968 |
| CGCUAUCAUGCGUUCUCCU | 826 | 969 |
| GACAGGGAAGACAUCACUG | 1634 | 970 |
| AUCAUACUGGCUAGUGGUG | 1208 | 971 |
| GCUGGUGACAGGGAAGACA | 1628 | 972 |
| AUCCUAGCUCGGGAUGUUC | 2003 | 973 |
| GUCCUGUAUGAGUGGGAAC | 452 | 974 |
| UGGGAUAUGUAUGGGUAGG | 3081 | 975 |

TABLE 1a-continued

CTNNB1 Target Sequences, noting human target sites.

| Target Sequence | Target Site (human) | SEQ ID NO: 1 |
|---|---|---|
| CUUGGACUUGAUAUUGGUG | 2354 | 976 |
| CCUUUGUCCCGCAAAUCAU | 1822 | 977 |
| UGAAGGUGCUAUCUGUCUG | 1299 | 978 |
| CCUUCACUCAAGAACAAGU | 486 | 979 |
| GAAGGUCUCCUUGGGACUC | 1463 | 980 |
| AGAAACGGCUUUCAGUUGA | 2280 | 981 |
| ACCCAGCGCCGUACGUCCA | 1907 | 982 |
| CAUAACCUUUCCCAUCAUC | 923 | 983 |
| GAAGGUUGUACCGGAGCCC | 1979 | 984 |
| GUCCCGCAAAUCAUGCACC | 1827 | 985 |
| CAAGCUCAUCAUACUGGCU | 1201 | 986 |
| CGCCGUACGUCCAUGGGUG | 1913 | 987 |
| AGAGUUACUUCACUCUAGG | 2191 | 988 |
| GUUGGACAUGGCCAUGGAA | 295 | 989 |
| UGGCUAUUACGACAGACUG | 1149 | 990 |
| ACUCGAGCUCAGAGGGUAC | 533 | 991 |
| ACAGUUUGAUGCUGCUCAU | 604 | 992 |
| GGUGGUUAAUAAGGCUGCA | 766 | 993 |
| CUUUGUCCCGCAAAUCAUG | 1823 | 994 |
| AAUACCAUUCCAUUGUUUG | 2048 | 995 |
| CCACACGUGCAAUCCCUGA | 714 | 996 |
| AUGGCCAGGAUGCCUUGGG | 2439 | 997 |
| GGAUACCCAGCGCCGUACG | 1903 | 998 |
| UCGCCAGGAUGAUCCUAGC | 2395 | 999 |
| UGGUCCAUCAGCUUUCUAA | 789 | 1000 |
| AUAUGUAUGGGUAGGGUAA | 3085 | 1001 |
| CCCAGAAUGCAGUUCGCCU | 1710 | 1002 |
| UAUUGUAGAAGCUGGGGAA | 1336 | 1003 |
| GUAUGGGUAGGGUAAAUCA | 3089 | 1004 |
| GAUCUUGGACUUGAUAUUG | 2351 | 1005 |
| ACACGUGCAAUCCCUGAAC | 716 | 1006 |
| AGCGCCGUACGUCCAUGGG | 1911 | 1007 |
| UGUACCGGAGCCCUUCACA | 1985 | 1008 |
| GUUGAUGGGCUGCCAGAUC | 2516 | 1009 |
| ACACCCACCAUCCCACUGG | 1762 | 1010 |
| UACGACAGACUGCCUUCAA | 1156 | 1011 |
| UUGUUCGUGCACAUCAGGA | 1887 | 1012 |
| CAAAUCAUGCACCUUUGCG | 1833 | 1013 |
| GUCUGGAGGCAUUCCUGCC | 967 | 1014 |
| CACUAUGGACUACCAGUUG | 1730 | 1015 |
| UAUCAUGCGUUCUCCUCAG | 829 | 1016 |
| GUAGAAACAGCUCGUUGUA | 890 | 1017 |
| CUCCUCUGACAGAGUUACU | 2181 | 1018 |
| UGCUCAGGACAAGGAAGCU | 2131 | 1019 |
| CAAGUGGGUGGUAUAGAGG | 1586 | 1020 |
| UGGUGGUUAAUAAGGCUGC | 765 | 1021 |
| ACUUCACCUGACAGAUCCA | 1369 | 1022 |
| CGCCUUCACUAUGGACUAC | 1724 | 1023 |
| UGCGUUCUCCUCAGAUGGU | 834 | 1024 |
| GUUGUACCGGAGCCCUUCA | 1983 | 1025 |
| CGACACCAAGAAGCAGAGA | 1688 | 1026 |
| UCACCAGUGGAUUCUGUGU | 1004 | 1027 |
| GGUGACAGGGAAGACAUCA | 1631 | 1028 |
| UCUAGUAAUAAGCCGGCUA | 1319 | 1029 |
| GUGGUUAAUAAGGCUGCAG | 767 | 1030 |
| UCCUCAGAUGGUGUCUGCU | 841 | 1031 |
| AUGGACAGUAUGCAAUGAC | 516 | 1032 |
| UGCGUGAGCAGGGUGCCAU | 1848 | 1033 |
| ACUCUAGGAAUGAAGGUGU | 2202 | 1034 |
| GACAUUAGAUGAGGGCAUG | 571 | 1035 |
| CUGGUGACAGGGAAGACAU | 1629 | 1036 |
| UGAUUCGAAAUCUUGCCCU | 1806 | 1037 |
| GCUCUUACACCCACCAUCC | 1756 | 1038 |
| GUCCUUCGGGCUGGUGACA | 1619 | 1039 |
| GUGCGUACUGUCCUUCGGG | 1610 | 1040 |
| UGGUGCUGACUAUCCAGUU | 2500 | 1041 |
| GCUAUUGAAGCUGAGGGAG | 2156 | 1042 |
| CAACCAAGAAAGCAAGCUC | 1189 | 1043 |
| GUGCAGCUGCUUUAUUCUC | 2066 | 1044 |
| CUAUCUGUCUGCUCUAGUA | 1307 | 1045 |
| AAACAGGAAGGGAUGGAAG | 1448 | 1046 |
| ACUGGCUAGUGGUGGACCC | 1213 | 1047 |
| CCUCUGUGAACUUGCUCAG | 2119 | 1048 |
| UGUAGAAACAGCUCGUUGU | 889 | 1049 |
| CUGACAGAUCCAAGUCAAC | 1376 | 1050 |

TABLE 1a-continued

CTNNB1 Target Sequences, noting human target sites.

| Target Sequence | Target Site (human) | SEQ ID NO: 1 |
|---|---|---|
| GGAAGAGGAUGUGGAUACC | 427 | 1051 |
| ACCAUCACAGAUGCUGAAA | 649 | 1052 |
| CCGUACGUCCAUGGGUGGG | 1915 | 1053 |
| CAUUCCAUUGUUUGUGCAG | 2053 | 1054 |
| CUCCAGGUGACAGCAAUCA | 2568 | 1055 |
| CUACCAGUUGUGGUUAAGC | 1739 | 1056 |
| UUGUGGUUAAGCUCUUACA | 1746 | 1057 |
| UAGUAAUAAGCCGGCUAUU | 1321 | 1058 |
| CAGUCCUUCACUCAAGAAC | 482 | 1059 |
| AGCUGAUUUGAUGGAGUUG | 280 | 1060 |
| AGGUCUCCUUGGGACUCUU | 1465 | 1061 |
| ACUAUGGACUACCAGUUGU | 1731 | 1062 |
| CAGCAGCAAUUUGUGGAGG | 1937 | 1063 |
| CGUGCACAUCAGGAUACCC | 1892 | 1064 |
| CGUUCUCCUCAGAUGGUGU | 836 | 1065 |
| CAGUAUGCAAUGACUCGAG | 521 | 1066 |
| GGUAUAGAGGCUCUUGUGC | 1595 | 1067 |
| AUCCAGUUGAUGGGCUGCC | 2511 | 1068 |
| UGCCAAGUGGGUGGUAUAG | 1583 | 1069 |
| ACAUCAGGAUACCCAGCGC | 1897 | 1070 |
| GCCAUCUUUAAGUCUGGAG | 956 | 1071 |
| AACCUUUCCCAUCAUCGUG | 926 | 1072 |
| CUAGUUCAGUUGCUUGUUC | 1874 | 1073 |
| UUCACUCAAGAACAAGUAG | 488 | 1074 |
| AAGAAGCAGAGAUGGCCCA | 1695 | 1075 |
| UCCUCUGACAGAGUUACUU | 2182 | 1076 |
| AAUUGUUAUCAGAGGACUA | 2029 | 1077 |
| UCUCAGUCCUUCACUCAAG | 479 | 1078 |
| UCCAGACACGCUAUCAUGC | 818 | 1079 |
| CACUAAUGUCCAGCGUUUG | 625 | 1080 |
| UUGUAACCUGCUGUGAUAC | 3172 | 1081 |
| CUUCUGGGUUCAGAUGAUA | 1490 | 1082 |
| GCCGUACGUCCAUGGGUGG | 1914 | 1083 |
| UAGUUGAAGGUUGUACCGG | 1974 | 1084 |
| GAGGACAAGCCACAAGAUU | 2258 | 1085 |
| GGGAGCCACAGCUCCUCUG | 2170 | 1086 |
| CUUCACCUGACAGAUCCAA | 1370 | 1087 |
| UCUUUCAGAUGCUGCAACU | 1429 | 1088 |
| UGUAACCUGCUGUGAUACG | 3173 | 1089 |
| CCUCCCAAGUCCUGUAUGA | 444 | 1090 |
| GGCAGUGCGUUUAGCUGGU | 1081 | 1091 |
| CUCUAGUAAUAAGCCGGCU | 1318 | 1092 |
| GCUGUUAGUCACUGGCAGC | 329 | 1093 |
| GUCAACGUCUUGUUCAGAA | 1389 | 1094 |
| GAAGAGGAUGUGGAUACCU | 428 | 1095 |
| UAACCUGCUGUGAUACGAU | 3175 | 1096 |
| GUUAUUUGGAACCUUGUUU | 3117 | 1097 |
| UCACAACCGAAUUGUUAUC | 2020 | 1098 |
| CGGGCUGGUGACAGGGAAG | 1625 | 1099 |
| ACAACCGAAUUGUUAUCAG | 2022 | 1100 |
| CCACUAAUGUCCAGCGUUU | 624 | 1101 |
| CACUGAGCCUGCCAUCUGU | 1648 | 1102 |
| GGUCCAUCAGCUUUCUAAA | 790 | 1103 |
| AUCCCAAAGUUGUUGUAAC | 3160 | 1104 |
| UGAGGACCUAUACUUACGA | 1251 | 1105 |
| UGUCUGAGGACAAGCCACA | 2253 | 1106 |
| AGUUGAUGGGCUGCCAGAU | 2515 | 1107 |
| UGACCAGCCGACACCAAGA | 1680 | 1108 |
| AGGGAGCCACAGCUCCUCU | 2169 | 1109 |
| AAAGUUGUUGUAACCUGCU | 3165 | 1110 |
| CUGCAGUUAUGGUCCAUCA | 780 | 1111 |
| UGAAGGUUGUACCGGAGCC | 1978 | 1112 |
| UUCCCUGAGACAUUAGAUG | 563 | 1113 |
| CUUCGGGCUGGUGACAGGG | 1622 | 1114 |
| UUGAGCUGACCAGCUCUCU | 2295 | 1115 |
| GAACUUGCUCAGGACAAGG | 2126 | 1116 |
| CCAGCCGACACCAAGAAGC | 1683 | 1117 |
| AGGGUGCCAUUCCACGACU | 1857 | 1118 |
| UUGUGCAGCUGCUUUAUUC | 2064 | 1119 |
| UCACUCAAGAACAAGUAGC | 489 | 1120 |
| GCUGGUGGAAUGCAAGCUU | 1346 | 1121 |
| GCAACUAAACAGGAAGGGA | 1442 | 1122 |
| AGGUUGUACCGGAGCCCUU | 1981 | 1123 |
| AGGCUGCAGUUAUGGUCCA | 777 | 1124 |
| GCAGAUCCCAUCUACACAG | 589 | 1125 |

TABLE 1a-continued

CTNNB1 Target Sequences, noting human target sites.

| Target Sequence | Target Site (human) | SEQ ID NO: 1 |
|---|---|---|
| CUAGGAAUGAAGGUGUGGC | 2205 | 1126 |
| AGCUCCUUCUCUGAGUGGU | 394 | 1127 |
| UUACAACUCUCCACAACCU | 1035 | 1128 |
| GGUAAAGGCAAUCCUGAGG | 410 | 1129 |
| GUUCGCCUUCACUAUGGAC | 1721 | 1130 |
| CAAAUGUUAAAUUCUUGGC | 1134 | 1131 |
| CUGUGAUACGAUGCUUCAA | 3182 | 1132 |
| ACAAAUGAUGUAGAAACAG | 881 | 1133 |
| GGUACGAGCUGCUAUGUUC | 547 | 1134 |
| GAAUUGUUAUCAGAGGACU | 2028 | 1135 |
| CAACCGAAUUGUUAUCAGA | 2023 | 1136 |
| GUGAUACGAUGCUUCAAGA | 3184 | 1137 |
| AAAGGCAAUCCUGAGGAAG | 413 | 1138 |
| CAGCUCCUCUGACAGAGUU | 2178 | 1139 |
| AUGGUCUGCCAAGUGGGUG | 1577 | 1140 |
| GCUACUGUUGGAUUGAUUC | 1793 | 1141 |
| UGCAAUGACUCGAGCUCAG | 526 | 1142 |
| GACUUGAUAUUGGUGCCCA | 2358 | 1143 |
| CAGAACUGUCUUUGGACUC | 1403 | 1144 |
| UAGUUCAGUUGCUUGUUCG | 1875 | 1145 |
| ACAGACUGCCUUCAAAUUU | 1160 | 1146 |
| GGGUGGUAUAGAGGCUCUU | 1591 | 1147 |
| AUGGACUACCAGUUGUGGU | 1734 | 1148 |
| AUUGUUAUCAGAGGACUAA | 2030 | 1149 |
| UAAGGCUGCAGUUAUGGUC | 775 | 1150 |
| AAAUCUUGCCCUUUGUCCC | 1813 | 1151 |
| AGCAGCAAUUUGUGGAGGG | 1938 | 1152 |
| AGAGGACUAAAUACCAUUC | 2039 | 1153 |
| GCUGAAGGUGCUAUCUGUC | 1297 | 1154 |
| UGUAUGAGUGGGAACAGGG | 456 | 1155 |
| CAGAUCCCAUCUACACAGU | 590 | 1156 |
| GACACAGCAGCAAUUUGUG | 1933 | 1157 |
| GGGCAUGCAGAUCCCAUCU | 583 | 1158 |
| CAUGCCAGGACCUCAUGG | 2540 | 1159 |
| GAAGCUGAGGGAGCCACAG | 2162 | 1160 |
| CUGUUAGUCACUGGCAGCA | 330 | 1161 |
| CUUGUUCAGCUUCUCGGGUU | 1481 | 1162 |
| AAGCUGGUGGAAUGCAAGC | 1344 | 1163 |
| GAGGAUGUGGAUACCUCCC | 431 | 1164 |
| AUAAAUGUGGUCACCUGUG | 1508 | 1165 |
| UACGUCCAUGGGUGGGACA | 1918 | 1166 |
| GAUGGAGUUGGACAUGGCC | 289 | 1167 |
| UGUCCAGCGUUUGGCUGAA | 631 | 1168 |
| GAGCAGGGUGCCAUUCCAC | 1853 | 1169 |
| AAAUAUAAUGAGGACCUAU | 1243 | 1170 |
| UACUGGCUAGUGGUGGACC | 1212 | 1171 |
| UGCUUGGUUCACCAGUGGA | 996 | 1172 |
| CUGAGGACAAGCCACAAGA | 2256 | 1173 |
| CUUGUGCGUACUGUCCUUC | 1607 | 1174 |
| UGUUAUUUGGAACCUUGUU | 3116 | 1175 |
| UAGCUUAUGGCAACCAAGA | 1179 | 1176 |
| UGAUACGAUGCUUCAAGAG | 3185 | 1177 |
| UGGUAUAGAGGCUCUUGUG | 1594 | 1178 |
| GAUGUAGAAACAGCUCGUU | 887 | 1179 |
| CCUUUCCCAUCAUCGUGAG | 928 | 1180 |
| GCGUUCUCCUCAGAUGGUG | 835 | 1181 |
| UCAGGAUACCCAGCGCCGU | 1900 | 1182 |
| ACGGCUUUCAGUUGAGCUG | 2284 | 1183 |
| GUUGAAGGUUGUACCGGAG | 1976 | 1184 |
| UAUCGCCAGGAUGAUCCUA | 2393 | 1185 |
| GUGCUGAAGGUGCUAUCUG | 1295 | 1186 |
| GUCUUUGGACUCUCAGGAA | 1410 | 1187 |
| GGGAUGGAAGGUCUCCUUG | 1457 | 1188 |
| UGAGCUGACCAGCUCUCUC | 2296 | 1189 |
| CUUUCCCAUCAUCGUGAGG | 929 | 1190 |
| AAGCUUUAGGACUUCACCU | 1359 | 1191 |
| UGGAAUGCAAGCUUUAGGA | 1351 | 1192 |
| CUGGAGGCAUUCCUGCCCU | 969 | 1193 |
| AGUUCAGUUGCUUGUUCGU | 1876 | 1194 |
| GAGCUGCUAUGUUCCCUGA | 552 | 1195 |
| GGCCAGGAUGCCUUGGGUA | 2441 | 1196 |
| GAUGAUCCUAGCUAUCGUU | 2402 | 1197 |
| GAUUGAUUCGAAAUCUUGC | 1803 | 1198 |
| CAGAGAUGGCCCAGAAUGC | 1701 | 1199 |
| CAGCGCCGUACGUCCAUGG | 1910 | 1200 |

TABLE 1a-continued

CTNNB1 Target Sequences, noting human target sites.

| Target Sequence | Target Site (human) | SEQ ID NO: 1 |
|---|---|---|
| AUGUAGAAACAGCUCGUUG | 888 | 1201 |
| AGUGCUGAAGGUGCUAUCU | 1294 | 1202 |
| GACUACCAGUUGUGGUUAA | 1737 | 1203 |
| ACAGGAAGGGAUGGAAGGU | 1450 | 1204 |
| CAGGUGGUGGUUAAUAAGG | 761 | 1205 |
| AAGGCUGCAGUUAUGGUCC | 776 | 1206 |
| UAAAUGUGGUCACCUGUGC | 1509 | 1207 |
| UAAAGGCUACUGUUGGAUU | 1788 | 1208 |
| GAUGGACAGUAUGCAAUGA | 515 | 1209 |
| UUCUGGGUUCAGAUGAUAU | 1491 | 1210 |
| GUACUGUCCUUCGGGCUGG | 1614 | 1211 |
| CUUGGUUCACCAGUGGAUU | 998 | 1212 |
| UAUUGAAGCUGAGGGAGCC | 2158 | 1213 |
| GUUGUUGUAACCUGCUGUG | 3168 | 1214 |
| AGCAGGGUGCCAUUCCACG | 1854 | 1215 |
| GUCCUCUGUGAACUUGCUC | 2117 | 1216 |
| UCUGACCAGCCGACACCAA | 1678 | 1217 |
| GCCAUGGAACCAGACAGAA | 305 | 1218 |
| AAGCUAUUGAAGCUGAGGG | 2154 | 1219 |
| GAUUCGAAAUCUUGCCCUU | 1807 | 1220 |
| AGUUGCUUGUUCGUGCACA | 1881 | 1221 |
| AAGAACAAGAUGAUGGUCU | 1565 | 1222 |
| AGUGGUAAAGGCAAUCCUG | 407 | 1223 |
| CAGAUGCUGCAACUAAACA | 1434 | 1224 |
| CCUGAGACAUUAGAUGAGG | 566 | 1225 |
| UCCCAAAGUUGUUGUAACC | 3161 | 1226 |
| CUGACCAGCCGACACCAAG | 1679 | 1227 |
| AUCCAAAGAGUAGCUGCAG | 2096 | 1228 |
| AUGUCCAGCGUUUGGCUGA | 630 | 1229 |
| UCUUGUGCGUACUGUCCUU | 1606 | 1230 |
| AGGAUGUGGAUACCUCCCA | 432 | 1231 |
| GGCUGCAGUUAUGGUCCAU | 778 | 1232 |
| UCACAUCCUAGCUCGGGAU | 1999 | 1233 |
| ACCAAGAAGCAGAGAUGGC | 1692 | 1234 |
| GCCACCACCCUGGUGCUGA | 2490 | 1235 |
| CCCACUAAUGUCCAGCGUU | 623 | 1236 |
| ACUGGCAGCAACAGUCUUA | 339 | 1237 |
| AUCUGAAUAAAGUGUAACA | 2946 | 1238 |
| GCCUGCCAUCUGUGCUCUU | 1654 | 1239 |
| CAUUACAACUCUCCACAAC | 1033 | 1240 |
| CUCCUCAGAUGGUGUCUGC | 840 | 1241 |
| CAGUUGCUUGUUCGUGCAC | 1880 | 1242 |
| AUCCUGAGGAAGAGGAUGU | 420 | 1243 |
| CACCAGUGGAUUCUGUGUU | 1005 | 1244 |
| CAAGAAAGCAAGCUCAUCA | 1193 | 1245 |
| CUUGCAUAACCUUUCCCAU | 919 | 1246 |
| CUUCACUAUGGACUACCAG | 1727 | 1247 |
| UUGCUUGUUCGUGCACAUC | 1883 | 1248 |
| UAUUGUACGUACCAUGCAG | 859 | 1249 |
| GAAAUCUUGCCCUUUGUCC | 1812 | 1250 |
| CUCUUGUGCGUACUGUCCU | 1605 | 1251 |
| CACAACCGAAUUGUUAUCA | 2021 | 1252 |
| GCUCCUCUGACAGAGUUAC | 2180 | 1253 |
| AGCGUUUGGCUGAACCAUC | 636 | 1254 |
| AAACGGCUUUCAGUUGAGC | 2282 | 1255 |
| UUUGUCCCGCAAAUCAUGC | 1824 | 1256 |
| UCUAGGAAUGAAGGUGUGG | 2204 | 1257 |
| AAGUCCUGUAUGAGUGGGA | 450 | 1258 |
| GGUUCACCAGUGGAUUCUG | 1001 | 1259 |
| GGUCUGCCAAGUGGGUGGU | 1579 | 1260 |
| AGCUCCUCUGACAGAGUUA | 2179 | 1261 |
| UUCUGGUGCCACUACCACA | 376 | 1262 |
| UGCUAUGUUCCCUGAGACA | 556 | 1263 |
| AUUGAUUCGAAAUCUUGCC | 1804 | 1264 |
| CUCAUGGAUGGGCUGCCUC | 2552 | 1265 |
| GCUGCUUUAUUCUCCCAUU | 2071 | 1266 |
| AUCAUGCACCUUUGCGUGA | 1836 | 1267 |
| GUCACUGGCAGCAACAGUC | 336 | 1268 |
| UGAGUGGGAACAGGGAUUU | 460 | 1269 |
| AAUUAUAAGAACAAGAUGA | 1559 | 1270 |
| UGGACAGUUUACCAGUUGC | 3136 | 1271 |
| AUGAGGACCUAUACUUACG | 1250 | 1272 |
| GGAAGGUCUCCUUGGGACU | 1462 | 1273 |
| UGGAAGAAAUAGUUGAAGG | 1965 | 1274 |
| GGUGUUAUUUGGAACCUUG | 3114 | 1275 |

TABLE 1a-continued

CTNNB1 Target Sequences, noting human target sites.

| Target Sequence | Target Site (human) | SEQ ID NO: 1 |
|---|---|---|
| GUGCUCUUCGUCAUCUGAC | 1665 | 1276 |
| GGCCAUGGAACCAGACAGA | 304 | 1277 |
| CGGCUGUUAGUCACUGGCA | 327 | 1278 |
| UUCCACGACUAGUUCAGUU | 1866 | 1279 |
| AGCAGAGAUGGCCCAGAAU | 1699 | 1280 |
| GCCAGGAUGAUCCUAGCUA | 2397 | 1281 |
| GCCAUCUGUGCUCUUCGUC | 1658 | 1282 |
| UAGAAACAGCUCGUUGUAC | 891 | 1283 |
| AGAUGAUGGUCUGCCAAGU | 1572 | 1284 |
| ACCUUUCCCAUCAUCGUGA | 927 | 1285 |
| AUGGAGUUGGACAUGGCCA | 290 | 1286 |
| CUGUGCUCUUCGUCAUCUG | 1663 | 1287 |
| UAUAAGAACAAGAUGAUGG | 1562 | 1288 |
| UCUGAAUAAAGUGUAACAA | 2947 | 1289 |
| CCAGAAUGCAGUUCGCCUU | 1711 | 1290 |
| AGAACAAGAUGAUGGUCUG | 1566 | 1291 |
| AUCUUGCCCUUUGUCCCGC | 1815 | 1292 |
| GCGUUUAGCUGGUGGGCUG | 1087 | 1293 |
| GGGUUCAGAUGAUAUAAAU | 1495 | 1294 |
| UUUAGGACUUCACCUGACA | 1363 | 1295 |
| CACAGCUCCUUCUCUGAGU | 391 | 1296 |
| AACGUCUUGUUCAGAACUG | 1392 | 1297 |
| CACAGCAGCAAUUUGUGGA | 1935 | 1298 |
| GACUAGUUCAGUUGCUUGU | 1872 | 1299 |
| GACAGACUGCCUUCAAAUU | 1159 | 1300 |
| CUCUCUCUUCAGAACAGAG | 2308 | 1301 |
| GUCCAGCGUUUGGCUGAAC | 632 | 1302 |
| UAAGAACAAGAUGAUGGUC | 1564 | 1303 |
| UCCAAGUCAACGUCUUGUU | 1384 | 1304 |
| ACACCAAGAAGCAGAGAUG | 1690 | 1305 |
| CUCAGGAAUCUUUCAGAUG | 1421 | 1306 |
| UAAAUUCUUGGCUAUUACG | 1141 | 1307 |
| CUAUGGACUACCAGUUGUG | 1732 | 1308 |
| CCAGCGUUUGGCUGAACCA | 634 | 1309 |
| UCCCAUCAUCGUGAGGGCU | 932 | 1310 |
| AGGACUUCACCUGACAGAU | 1366 | 1311 |
| UUGUGCGUACUGUCCUUCG | 1608 | 1312 |
| CCAUGGGUGGGACACAGCA | 1923 | 1313 |
| GGAUGGAAGGUCUCCUUGG | 1458 | 1314 |
| CCCAGCGCCGUACGUCCAU | 1908 | 1315 |
| GCUCAGAGGGUACGAGCUG | 539 | 1316 |
| AUGUUCACAACCGAAUUGU | 2016 | 1317 |
| UGCUUGUUCGUGCACAUCA | 1884 | 1318 |
| AUGUUCCCUGAGACAUUAG | 560 | 1319 |
| GUAAAGGCAAUCCUGAGGA | 411 | 1320 |
| CACUGGCAGCAACAGUCUU | 338 | 1321 |
| AUCAUGCGUUCUCCUCAGA | 830 | 1322 |
| UAUGUAUGGGUAGGGUAAA | 3086 | 1323 |
| GUGUUAUUGGAACCUUGU | 3115 | 1324 |
| ACAGCUCCUCUGACAGAGU | 2177 | 1325 |
| UAUGGACUACCAGUUGUGG | 1733 | 1326 |
| AUUCUGGUGCCACUACCAC | 375 | 1327 |
| UGCCUCCAGGUGACAGCAA | 2565 | 1328 |
| UACCUCCCAAGUCCUGUAU | 442 | 1329 |
| CCAGACACGCUAUCAUGCG | 819 | 1330 |
| UGAUGCAGAACUUGCCACA | 700 | 1331 |
| GUUUAGCUGGUGGGCUGCA | 1089 | 1332 |
| GUCUGCCAAGUGGGUGGUA | 1580 | 1333 |
| GGUUGUACCGGAGCCCUUC | 1982 | 1334 |
| GUACCGGAGCCCUUCACAU | 1986 | 1335 |
| CAAUCCUGAGGAAGAGGAU | 418 | 1336 |
| GCUAUCUGUCUGCUCUAGU | 1306 | 1337 |
| UGACAGAUCCAAGUCAACG | 1377 | 1338 |
| CAUGAUGGAACAUGAGAUG | 2467 | 1339 |
| UUGGACUCUCAGGAAUCUU | 1414 | 1340 |
| CUCUUCGUCAUCUGACCAG | 1668 | 1341 |
| UUGCCCUUUGUCCCGCAAA | 1818 | 1342 |
| GAAGCAGAGAUGGCCCAGA | 1697 | 1343 |
| CCUUGCAUAACCUUUCCCA | 918 | 1344 |
| CAGUUUGAUGCUGCUCAUC | 605 | 1345 |
| ACCUGACAGAUCCAAGUCA | 1374 | 1346 |
| CUUUCAGAUGCUGCAACUA | 1430 | 1347 |
| GAUACGAUGCUUCAAGAGA | 3186 | 1348 |
| AUGCAAGCUUUAGGACUUC | 1355 | 1349 |
| GGAUGUGGAUACCUCCCAA | 433 | 1350 |

TABLE 1a-continued

CTNNB1 Target Sequences, noting human target sites.

| Target Sequence | Target Site (human) | SEQ ID NO: 1 |
|---|---|---|
| AGAAUGCAGUUCGCCUUCA | 1713 | 1351 |
| CGAAAUCUUGCCCUUUGUC | 1811 | 1352 |
| ACUCAAGAACAAGUAGCUG | 491 | 1353 |
| GAAUGAAGGUGUGGCGACA | 2209 | 1354 |
| UGCACCUUUGCGUGAGCAG | 1840 | 1355 |
| ACGAGCUGCUAUGUUCCCU | 550 | 1356 |
| AAGAGGAUGUGGAUACCUC | 429 | 1357 |
| GAUAUGGCCAGGAUGCCUU | 2436 | 1358 |
| UAUAGAGGCUCUUGUGCGU | 1597 | 1359 |
| GGUUCAGAUGAUAUAAAUG | 1496 | 1360 |
| AGGGAUGGAAGGUCUCCUU | 1456 | 1361 |
| UAUCCCAAAGUUGUUGUAA | 3159 | 1362 |
| UCUCUCUUCAGAACAGAGC | 2309 | 1363 |
| CUGACCAGCUCUCUCUUCA | 2300 | 1364 |
| ACCUGCUGUGAUACGAUGC | 3177 | 1365 |
| AUGGCAGUGCGUUUAGCUG | 1079 | 1366 |
| AUCCAAGUCAACGUCUUGU | 1383 | 1367 |
| GCUGCCUCCAGGUGACAGC | 2563 | 1368 |
| AGUGCGUUUAGCUGGUGGG | 1084 | 1369 |
| AGCCGGCUAUUGUAGAAGC | 1329 | 1370 |
| CAUUAGAUGAGGGCAUGCA | 573 | 1371 |
| GAAGGUGUGGCGACAUAUG | 2213 | 1372 |
| AAGUGGGUGGUAUAGAGGC | 1587 | 1373 |
| CUGAGGGAGCCACAGCUCC | 2166 | 1374 |
| GCGUUUGGCUGAACCAUCA | 637 | 1375 |
| UCCUUCUCUGAGUGGUAAA | 397 | 1376 |
| GCAGUUCGCCUUCACUAUG | 1718 | 1377 |
| GGACUUGAUAUUGGUGCCC | 2357 | 1378 |
| GUUUGGCUGAACCAUCACA | 639 | 1379 |
| GCAUGCAGAUCCCAUCUAC | 585 | 1380 |
| GAUGGGCUGCCAGAUCUGG | 2519 | 1381 |
| GGACUUCACCUGACAGAUC | 1367 | 1382 |
| CAACGUCUUGUUCAGAACU | 1391 | 1383 |
| GAUAUUGAUGGACAGUAUG | 509 | 1384 |
| UGGCCAUGGAACCAGACAG | 303 | 1385 |
| CAAGAACAAGUAGCUGAUA | 494 | 1386 |
| GGCUGUUAGUCACUGGCAG | 328 | 1387 |
| CAUUGUUUGUGCAGCUGCU | 2058 | 1388 |

TABLE 1a-continued

CTNNB1 Target Sequences, noting human target sites.

| Target Sequence | Target Site (human) | SEQ ID NO: 1 |
|---|---|---|
| UAAACAGGAAGGGAUGGAA | 1447 | 1389 |
| AUAAGAACAAGAUGAUGGU | 1563 | 1390 |
| GUGGAAUGCAAGCUUUAGG | 1350 | 1391 |
| GGAAUGAAGGUGUGGCGAC | 2208 | 1392 |
| GACACCAAGAAGCAGAGAU | 1689 | 1393 |
| ACUGUCUUUGGACUCUCAG | 1407 | 1394 |
| GGACAAGGAAGCUGCAGAA | 2137 | 1395 |
| UCUGCUAUUGUACGUACCA | 854 | 1396 |
| AGCUGCUUUAUUCUCCCAU | 2070 | 1397 |
| AGGGUACGAGCUGCUAUGU | 545 | 1398 |
| GAAGACAUCACUGAGCCUG | 1640 | 1399 |
| CGGGAUGUUCACAACCGAA | 2012 | 1400 |
| CAGCCGACACCAAGAAGCA | 1684 | 1401 |
| UGUUCACAACCGAAUUGUU | 2017 | 1402 |
| GCUCUCUCUUCAGAACAGA | 2307 | 1403 |
| UCAGAUGGUGUCUGCUAUU | 844 | 1404 |
| UGAGUGGUAAAGGCAAUCC | 405 | 1405 |
| UGGUGCCACUACCACAGCU | 379 | 1406 |
| UUGUCCCGCAAAUCAUGCA | 1825 | 1407 |
| CACCCUGGUGCUGACUAUC | 2495 | 1408 |
| AAUGUCCAGCGUUUGGCUG | 629 | 1409 |
| GGGCUGCCUCCAGGUGACA | 2561 | 1410 |
| GAGUUACUUCACUCUAGGA | 2192 | 1411 |
| UUCGAAAUCUUGCCCUUUG | 1809 | 1412 |
| GUAUAGAGGCUCUUGUGCG | 1596 | 1413 |
| AGCUGACCAGCUCUCUCUU | 2298 | 1414 |
| CUAUUGUACGUACCAUGCA | 858 | 1415 |
| UAUGCAAUGACUCGAGCUC | 524 | 1416 |
| UGCCCAGGACCUCAUGGAU | 2542 | 1417 |
| AACAAGUAGCUGAUAUUGA | 498 | 1418 |
| AAGGCAAUCCUGAGGAAGA | 414 | 1419 |
| CAAGAUGAUGGUCUGCCAA | 1570 | 1420 |
| UGCCAUUACAACUCUCCAC | 1030 | 1421 |
| AUGUAUGGGUAGGGUAAAU | 3087 | 1422 |
| UGUGCUCUUCGUCAUCUGA | 1664 | 1423 |
| AAGGCUACUGUUGGAUUGA | 1790 | 1424 |
| UACUGUCCUUCGGGCUGGU | 1615 | 1425 |

TABLE 1a-continued

CTNNB1 Target Sequences, noting human target sites.

| Target Sequence | Target Site (human) | SEQ ID NO: 1 |
|---|---|---|
| AUAAGGCUGCAGUUAUGGU | 774 | 1426 |
| UCGUCAUCUGACCAGCCGA | 1672 | 1427 |
| GUUGUAACCUGCUGUGAUA | 3171 | 1428 |
| AAGAUUACAAGAAACGGCU | 2271 | 1429 |
| UUAUGGCAACCAAGAAAGC | 1183 | 1430 |
| UCCAGUUGAUGGGCUGCCA | 2512 | 1431 |
| GGGACACAGCAGCAAUUUG | 1931 | 1432 |
| AUGAUGGAACAUGAGAUGG | 2468 | 1433 |
| UAUUUGGGAUAUGUAUGGG | 3077 | 1434 |
| CAGCUGCUUUAUUCUCCCA | 2069 | 1435 |
| GCUACUCAAGCUGAUUUGA | 272 | 1436 |
| UCCCUGAGACAUUAGAUGA | 564 | 1437 |
| GUGGAUACCUCCCAAGUCC | 437 | 1438 |
| UAGGAAUGAAGGUGUGGCG | 2206 | 1439 |
| UGACAGAGUUACUUCACUC | 2187 | 1440 |
| AGCGGCUGUUAGUCACUGG | 325 | 1441 |
| AUGGUUCAGAAUUAAACUU | 3222 | 1442 |
| AACCGAAUUGUUAUCAGAG | 2024 | 1443 |
| GGGUGCCAUUCCACGACUA | 1858 | 1444 |
| AUGAUGGUCUGCCAAGUGG | 1574 | 1445 |
| CACAUCAGGAUACCCAGCG | 1896 | 1446 |
| AGGAAUGAAGGUGUGGCGA | 2207 | 1447 |
| GAAGGUGCUAUCUGUCUGC | 1300 | 1448 |
| CCAAGAAAGCAAGCUCAUC | 1192 | 1449 |
| CGAGCUGCUAUGUUCCCUG | 551 | 1450 |
| CCUGGUGCUGACUAUCCAG | 2498 | 1451 |
| UGCUAUCUGUCUGCUCUAG | 1305 | 1452 |
| AUUGUAGAAGCUGGUGGAA | 1337 | 1453 |

TABLE 1b

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 535 | 1 | UCGAGCUCAGAGGGUACGA | UCGUACCCUCUGAGCUCGA | 4914 |
| 1601 | 2 | GAGGCUCUUGUGCGUACUG | CAGUACGCACAAGAGCCUC | 4915 |
| 1709 | 3 | GCCCAGAAUGCAGUUCGCC | GGCGAACUGCAUUCUGGGC | 4916 |
| 536 | 4 | CGAGCUCAGAGGGUACGAG | CUCGUACCCUCUGAGCUCG | 4917 |
| 1797 | 5 | CUGUUGGAUUGAUUCGAAA | UUUCGAAUCAAUCCAACAG | 4918 |
| 853 | 6 | GUCUGCUAUUGUACGUACC | GGUACGUACAAUAGCAGAC | 4919 |
| 1143 | 7 | AAUUCUUGGCUAUUACGAC | GUCGUAAUAGCCAAGAAUU | 4920 |
| 2014 | 8 | GGAUGUUCACAACCGAAUU | AAUUCGGUUGUGAACAUCC | 4921 |
| 520 | 9 | ACAGUAUGCAAUGACUCGA | UCGAGUCAUUGCAUACUGU | 4922 |
| 814 | 10 | AGCUUCCAGACACGCUAUC | GAUAGCGUGUCUGGAAGCU | 4923 |
| 852 | 11 | UGUCUGCUAUUGUACGUAC | GUACGUACAAUAGCAGACA | 4924 |
| 1796 | 12 | ACUGUUGGAUUGAUUCGAA | UUCGAAUCAAUCCAACAGU | 4925 |
| 1901 | 13 | CAGGAUACCCAGCGCCGUA | UACGGCGCUGGGUAUCCUG | 4926 |
| 822 | 14 | GACACGCUAUCAUGCGUUC | GAACGCAUGAUAGCGUGUC | 4927 |
| 1795 | 15 | UACUGUUGGAUUGAUUCGA | UCGAAUCAAUCCAACAGUA | 4928 |
| 1145 | 16 | UUCUUGGCUAUUACGACAG | CUGUCGUAAUAGCCAAGAA | 4929 |
| 823 | 17 | ACACGCUAUCAUGCGUUCU | AGAACGCAUGAUAGCGUGU | 4930 |
| 820 | 18 | CAGACACGCUAUCAUGCGU | ACGCAUGAUAGCGUGUCUG | 4931 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1798 | 19 | UGUUGGAUUGAUUCGAAAU | AUUUCGAAUCAAUCCAACA | 4932 |
| 1380 | 20 | CAGAUCCAAGUCAACGUCU | AGACGUUGACUUGGAUCUG | 4933 |
| 1602 | 21 | AGGCUCUUGUGCGUACUGU | ACAGUACGCACAAGAGCCU | 4934 |
| 1612 | 22 | GCGUACUGUCCUUCGGGCU | AGCCCGAAGGACAGUACGC | 4935 |
| 626 | 23 | ACUAAUGUCCAGCGUUUGG | CCAAACGCUGGACAUUAGU | 4936 |
| 2000 | 24 | CACAUCCUAGCUCGGGAUG | CAUCCCGAGCUAGGAUGUG | 4937 |
| 2665 | 25 | GUUGCUGAGAGGGCUCGAG | CUCGAGCCCUCUCAGCAAC | 4938 |
| 1676 | 26 | CAUCUGACCAGCCGACACC | GGUGUCGGCUGGUCAGAUG | 4939 |
| 1611 | 27 | UGCGUACUGUCCUUCGGGC | GCCCGAAGGACAGUACGCA | 4940 |
| 2269 | 28 | ACAAGAUUACAAGAAACGG | CCGUUUCUUGUAAUCUUGU | 4941 |
| 674 | 29 | GUUGUAAACUUGAUUAACU | AGUUAAUCAAGUUUACAAC | 4942 |
| 678 | 30 | UAAACUUGAUUAACUAUCA | UGAUAGUUAAUCAAGUUUA | 4943 |
| 1245 | 31 | AUAUAAUGAGGACCUAUAC | GUAUAGGUCCUCAUUAUAU | 4944 |
| 679 | 32 | AAACUUGAUUAACUAUCAA | UUGAUAGUUAAUCAAGUUU | 4945 |
| 1970 | 33 | GAAAUAGUUGAAGGUUGUA | UACAACCUUCAACUAUUUC | 4946 |
| 1247 | 34 | AUAAUGAGGACCUAUACUU | AAGUAUAGGUCCUCAUUAU | 4947 |
| 1140 | 35 | UUAAAUUCUUGGCUAUUAC | GUAAUAGCCAAGAAUUUAA | 4948 |
| 676 | 36 | UGUAAACUUGAUUAACUAU | AUAGUUAAUCAAGUUUACA | 4949 |
| 677 | 37 | GUAAACUUGAUUAACUAUC | GAUAGUUAAUCAAGUUUAC | 4950 |
| 675 | 38 | UUGUAAACUUGAUUAACUA | UAGUUAAUCAAGUUUACAA | 4951 |
| 1235 | 39 | GCUUUAGUAAAUAUAAUGA | UCAUUAUAUUUACUAAAGC | 4952 |
| 2488 | 40 | UGGCCACCACCCUGGUGCU | AGCACCAGGGUGGUGGCCA | 4953 |
| 1236 | 41 | CUUUAGUAAAUAUAAUGAG | CUCAUUAUAUUUACUAAAG | 4954 |
| 1237 | 42 | UUUAGUAAAUAUAAUGAGG | CCUCAUUAUAUUUACUAAA | 4955 |
| 2555 | 43 | GUAAAUCGUCCUUUAGGUA | UACCUAAAGGACGAUUUAC | 4956 |
| 1545 | 44 | ACCUCACUUGCAAUAAUUA | UAAUUAUUGCAAGUGAGGU | 4957 |
| 2050 | 45 | UACCAUUCCAUUGUUUGUG | CACAAACAAUGGAAUGGUA | 4958 |
| 2097 | 46 | UCCAAAGAGUAGCUGCAGG | CCUGCAGCUACUCUUUGGA | 4959 |
| 2510 | 47 | UAUCCAGUUGAUGGGCUGC | GCAGCCCAUCAACUGGAUA | 4960 |
| 871 | 48 | CAUGCAGAAUACAAAUGAU | AUCAUUUGUAUUCUGCAUG | 4961 |
| 2098 | 49 | CCAAAGAGUAGCUGCAGGG | CCCUGCAGCUACUCUUUGG | 4962 |
| 1767 | 50 | CACCAUCCCACUGGCCUCU | AGAGGCCAGUGGGAUGGUG | 4963 |
| 869 | 51 | ACCAUGCAGAAUACAAAUG | CAUUUGUAUUCUGCAUGGU | 4964 |
| 1641 | 52 | AAGACAUCACUGAGCCUGC | GCAGGCUCAGUGAUGUCUU | 4965 |
| 2582 | 53 | AAUCAGCUGGCCUGGUUUG | CAAACCAGGCCAGCUGAUU | 4966 |
| 1544 | 54 | AACCUCACUUGCAAUAAUU | AAUUAUUGCAAGUGAGGUU | 4967 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2550 | 55 | ACCUCAUGGAUGGGCUGCC | GGCAGCCCAUCCAUGAGGU | 4968 |
| 2051 | 56 | ACCAUUCCAUUGUUUGUGC | GCACAAACAAUGGAAUGGU | 4969 |
| 870 | 57 | CCAUGCAGAAUACAAAUGA | UCAUUUGUAUUCUGCAUGG | 4970 |
| 1670 | 58 | CUUCGUCAUCUGACCAGCC | GGCUGGUCAGAUGACGAAG | 4971 |
| 2122 | 59 | CUGUGAACUUGCUCAGGAC | GUCCUGAGCAAGUUCACAG | 4972 |
| 1642 | 60 | AGACAUCACUGAGCCUGCC | GGCAGGCUCAGUGAUGUCU | 4973 |
| 2324 | 61 | GAGCCAAUGGCUUGGAAUG | CAUUCCAAGCCAUUGGCUC | 4974 |
| 1649 | 62 | ACUGAGCCUGCCAUCUGUG | CACAGAUGGCAGGCUCAGU | 4975 |
| 2159 | 63 | AUUGAAGCUGAGGGAGCCA | UGGCUCCCUCAGCUUCAAU | 4976 |
| 785 | 64 | GUUAUGGUCCAUCAGCUUU | AAAGCUGAUGGACCAUAAC | 4977 |
| 1511 | 65 | AAUGUGGUCACCUGUGCAG | CUGCACAGGUGACCACAUU | 4978 |
| 2586 | 66 | AGCUGGCCUGGUUUGAUAC | GUAUCAAACCAGGCCAGCU | 4979 |
| 642 | 67 | UGGCUGAACCAUCACAGAU | AUCUGUGAUGGUUCAGCCA | 4980 |
| 1763 | 68 | CACCCACCAUCCCACUGGC | GCCAGUGGGAUGGUGGGUG | 4981 |
| 2328 | 69 | CAAUGGCUUGGAAUGAGAC | GUCUCAUUCCAAGCCAUUG | 4982 |
| 1280 | 70 | UGGACCACAAGCAGAGUGC | GCACUCUGCUUGUGGUCCA | 4983 |
| 2052 | 71 | CCAUUCCAUUGUUUGUGCA | UGCACAAACAAUGGAAUGG | 4984 |
| 2546 | 72 | CAGGACCUCAUGGAUGGGC | GCCCAUCCAUGAGGUCCUG | 4985 |
| 2124 | 73 | GUGAACUUGCUCAGGACAA | UUGUCCUGAGCAAGUUCAC | 4986 |
| 2545 | 74 | CCAGGACCUCAUGGAUGGG | CCCAUCCAUGAGGUCCUGG | 4987 |
| 643 | 75 | GGCUGAACCAUCACAGAUG | CAUCUGUGAUGGUUCAGCC | 4988 |
| 2501 | 76 | GGUGCUGACUAUCCAGUUG | CAACUGGAUAGUCAGCACC | 4989 |
| 2330 | 77 | AUGGCUUGGAAUGAGACUG | CAGUCUCAUUCCAAGCCAU | 4990 |
| 1638 | 78 | GGGAAGACAUCACUGAGCC | GGCUCAGUGAUGUCUUCCC | 4991 |
| 1630 | 79 | UGGUGACAGGGAAGACAUC | GAUGUCUUCCCUGUCACCA | 4992 |
| 616 | 80 | UGCUCAUCCCACUAAUGUC | GACAUUAGUGGGAUGAGCA | 4993 |
| 2509 | 81 | CUAUCCAGUUGAUGGGCUG | CAGCCCAUCAACUGGAUAG | 4994 |
| 2548 | 82 | GGACCUCAUGGAUGGGCUG | CAGCCCAUCCAUGAGGUCC | 4995 |
| 1773 | 83 | CCCACUGGCCUCUGAUAAA | UUUAUCAGAGGCCAGUGGG | 4996 |
| 2247 | 84 | UCCGAAUGUCUGAGGACAA | UUGUCCUCAGACAUUCGGA | 4997 |
| 2331 | 85 | UGGCUUGGAAUGAGACUGC | GCAGUCUCAUUCCAAGCCA | 4998 |
| 1498 | 86 | UUCAGAUGAUAUAAAUGUG | CACAUUUAUAUCAUCUGAA | 4999 |
| 2267 | 87 | CCACAAGAUUACAAGAAAC | GUUUCUUGUAAUCUUGUGG | 5000 |
| 1547 | 88 | CUCACUUGCAAUAAUUAUA | UAUAAUUAUUGCAAGUGAG | 5001 |
| 1549 | 89 | CACUUGCAAUAAUUAUAAG | CUUAUAAUUAUUGCAAGUG | 5002 |
| 867 | 90 | GUACCAUGCAGAAUACAAA | UUUGUAUUCUGCAUGGUAC | 5003 |
| 1390 | 91 | UCAACGUCUUGUUCAGAAC | GUUCUGAACAAGACGUUGA | 5004 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 593 | 92 | AUCCCAUCUACACAGUUUG | CAAACUGUGUAGAUGGGAU | 5005 |
| 274 | 93 | UACUCAAGCUGAUUUGAUG | CAUCAAAUCAGCUUGAGUA | 5006 |
| 759 | 94 | ACCAGGUGGUGGUUAAUAA | UUAUUAACCACCACCUGGU | 5007 |
| 1439 | 95 | GCUGCAACUAAACAGGAAG | CUUCCUGUUUAGUUGCAGC | 5008 |
| 1801 | 96 | UGGAUUGAUUCGAAAUCUU | AAGAUUUCGAAUCAAUCCA | 5009 |
| 1500 | 97 | CAGAUGAUAUAAAUGUGGU | ACCACAUUUAUAUCAUCUG | 5010 |
| 848 | 98 | AUGGUGUCUGCUAUUGUAC | GUACAAUAGCAGACACCAU | 5011 |
| 2268 | 99 | CACAAGAUUACAAGAAACG | CGUUUCUUGUAAUCUUGUG | 5012 |
| 882 | 100 | CAAAUGAUGUAGAAACAGC | GCUGUUUCUACAUCAUUUG | 5013 |
| 2266 | 101 | GCCACAAGAUUACAAGAAA | UUUCUUGUAAUCUUGUGGC | 5014 |
| 880 | 102 | UACAAAUGAUGUAGAAACA | UGUUUCUACAUCAUUUGUA | 5015 |
| 1810 | 103 | UCGAAAUCUUGCCCUUUGU | ACAAAGGGCAAGAUUUCGA | 5016 |
| 685 | 104 | GAUUAACUAUCAAGAUGAU | AUCAUCUUGAUAGUUAAUC | 5017 |
| 1007 | 105 | CCAGUGGAUUCUGUGUUGU | ACAACACAGAAUCCACUGG | 5018 |
| 1789 | 106 | AAAGGCUACUGUUGGAUUG | CAAUCCAACAGUAGCCUUU | 5019 |
| 499 | 107 | ACAAGUAGCUGAUAUUGAU | AUCAAUAUCAGCUACUUGU | 5020 |
| 2470 | 108 | GAUGGAACAUGAGAUGGGU | ACCCAUCUCAUGUUCCAUC | 5021 |
| 694 | 109 | UCAAGAUGAUGCAGAACUU | AAGUUCUGCAUCAUCUUGA | 5022 |
| 278 | 110 | CAAGCUGAUUUGAUGGAGU | ACUCCAUCAAAUCAGCUUG | 5023 |
| 1415 | 111 | UGGACUCUCAGGAAUCUUU | AAAGAUUCCUGAGAGUCCA | 5024 |
| 2046 | 112 | UAAAUACCAUUCCAUUGUU | AACAAUGGAAUGGUAUUUA | 5025 |
| 1057 | 113 | AUUACAUCAAGAAGGAGCU | AGCUCCUUCUUGAUGUAAU | 5026 |
| 1422 | 114 | UCAGGAAUCUUUCAGAUGC | GCAUCUGAAAGAUUCCUGA | 5027 |
| 684 | 115 | UGAUUAACUAUCAAGAUGA | UCAUCUUGAUAGUUAAUCA | 5028 |
| 2197 | 116 | ACUUCACUCUAGGAAUGAA | UUCAUUCCUAGAGUGAAGU | 5029 |
| 666 | 117 | AACAUGCAGUUGUAAACUU | AAGUUUACAACUGCAUGUU | 5030 |
| 279 | 118 | AAGCUGAUUUGAUGGAGUU | AACUCCAUCAAAUCAGCUU | 5031 |
| 1492 | 119 | UCUGGGUUCAGAUGAUAUA | UAUAUCAUCUGAACCCAGA | 5032 |
| 2195 | 120 | UUACUUCACUCUAGGAAUG | CAUUCCUAGAGUGAAGUAA | 5033 |
| 1424 | 121 | AGGAAUCUUUCAGAUGCUG | CAGCAUCUGAAAGAUUCCU | 5034 |
| 661 | 122 | GCUGAAACAUGCAGUUGUA | UACAACUGCAUGUUUCAGC | 5035 |
| 1882 | 123 | GUUGCUUGUUCGUGCACAU | AUGUGCACGAACAAGCAAC | 5036 |
| 1966 | 124 | GGAAGAAAUAGUUGAAGGU | ACCUUCAACUAUUUCUUCC | 5037 |
| 2259 | 125 | AGGACAAGCCACAAGAUUA | UAAUCUUGUGGCUUGUCCU | 5038 |
| 832 | 126 | CAUGCGUUCUCCUCAGAUG | CAUCUGAGGAGAACGCAUG | 5039 |
| 2346 | 127 | GAUGAUCCCAGCUACCGUU | AACGGUAGCUGGGAUCAUC | 5040 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1653 | 128 | AGCCUGCCAUCUGUGCUCU | AGAGCACAGAUGGCAGGCU | 5041 |
| 2389 | 129 | UGGAUAUCGCCAGGAUGAU | AUCAUCCUGGCGAUAUCCA | 5042 |
| 1669 | 130 | UCUUCGUCAUCUGACCAGC | GCUGGUCAGAUGACGAAGA | 5043 |
| 2123 | 131 | UGUGAACUUGCUCAGGACA | UGUCCUGAGCAAGUUCACA | 5044 |
| 1521 | 132 | CCUGUGCAGCUGGAAUUCU | AGAAUUCCAGCUGCACAGG | 5045 |
| 2125 | 133 | UGAACUUGCUCAGGACAAG | CUUGUCCUGAGCAAGUUCA | 5046 |
| 2503 | 134 | UGCUGACUAUCCAGUUGAU | AUCAACUGGAUAGUCAGCA | 5047 |
| 1502 | 135 | GAUGAUAUAAAUGUGGUCA | UGACCACAUUUAUAUCAUC | 5048 |
| 2502 | 136 | GUGCUGACUAUCCAGUUGA | UCAACUGGAUAGUCAGCAC | 5049 |
| 2506 | 137 | UGACUAUCCAGUUGAUGGG | CCCAUCAACUGGAUAGUCA | 5050 |
| 2127 | 138 | AACUUGCUCAGGACAAGGA | UCCUUGUCCUGAGCAAGUU | 5051 |
| 2505 | 139 | CUGACUAUCCAGUUGAUGG | CCAUCAACUGGAUAGUCAG | 5052 |
| 617 | 140 | GCUCAUCCCACUAAUGUCC | GGACAUUAGUGGGAUGAGC | 5053 |
| 2504 | 141 | GCUGACUAUCCAGUUGAUG | CAUCAACUGGAUAGUCAGC | 5054 |
| 1503 | 142 | AUGAUAUAAAUGUGGUCAC | GUGACCACAUUUAUAUCAU | 5055 |
| 618 | 143 | CUCAUCCCACUAAUGUCCA | UGGACAUUAGUGGGAUGAG | 5056 |
| 2074 | 144 | GCUUUAUUCUCCCAUUGAA | UUCAAUGGGAGAAUAAAGC | 5057 |
| 2499 | 145 | CUGGUGCUGACUAUCCAGU | ACUGGAUAGUCAGCACCAG | 5058 |
| 1406 | 146 | AACUGUCUUUGGACUCUCA | UGAGAGUCCAAAGACAGUU | 5059 |
| 582 | 147 | AGGGCAUGCAGAUCCCAUC | GAUGGGAUCUGCAUGCCCU | 5060 |
| 1505 | 148 | GAUAUAAAUGUGGUCACCU | AGGUGACCACAUUUAUAUC | 5061 |
| 1432 | 149 | UUCAGAUGCUGCAACUAAA | UUUAGUUGCAGCAUCUGAA | 5062 |
| 1968 | 150 | AAGAAAUAGUUGAAGGUUG | CAACCUUCAACUAUUUCUU | 5063 |
| 2398 | 151 | CCAGGAUGAUCCUAGCUAU | AUAGCUAGGAUCAUCCUGG | 5064 |
| 954 | 152 | UGGCCAUCUUUAAGUCUGG | CCAGACUUAAAGAUGGCCA | 5065 |
| 505 | 153 | AGCUGAUAUUGAUGGACAG | CUGUCCAUCAAUAUCAGCU | 5066 |
| 2011 | 154 | UCGGGAUGUUCACAACCGA | UCGGUUGUGAACAUCCCGA | 5067 |
| 1339 | 155 | UGUAGAAGCUGGUGGAAUG | CAUUCCACCAGCUUCUACA | 5068 |
| 1242 | 156 | UAAAUAUAAUGAGGACCUA | UAGGUCCUCAUUAUAUUUA | 5069 |
| 567 | 157 | CUGAGACAUUAGAUGAGGG | CCCUCAUCUAAUGUCUCAG | 5070 |
| 1240 | 158 | AGUAAAUAUAAUGAGGACC | GGUCCUCAUUAUAUUUACU | 5071 |
| 438 | 159 | UGGAUACCUCCCAAGUCCU | AGGACUUGGGAGGUAUCCA | 5072 |
| 2445 | 160 | AGGAUGCCUUGGGUAUGGA | UCCAUACCCAAGGCAUCCU | 5073 |
| 860 | 161 | AUUGUACGUACCAUGCAGA | UCUGCAUGGUACGUACAAU | 5074 |
| 1413 | 162 | UUUGGACUCUCAGGAAUCU | AGAUUCCUGAGAGUCCAAA | 5075 |
| 1800 | 163 | UUGGAUUGAUUCGAAAUCU | AGAUUUCGAAUCAAUCCAA | 5076 |
| 2037 | 164 | UCAGAGGACUAAAUACCAU | AUGGUAUUUAGUCCUCUGA | 5077 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2443 | 165 | CCAGGAUGCCUUGGGUAUG | CAUACCCAAGGCAUCCUGG | 5078 |
| 2471 | 166 | AUGGAACAUGAGAUGGGUG | CACCCAUCUCAUGUUCCAU | 5079 |
| 1792 | 167 | GGCUACUGUUGGAUUGAUU | AAUCAAUCCAACAGUAGCC | 5080 |
| 2547 | 168 | AGGACCUCAUGGAUGGGCU | AGCCCAUCCAUGAGGUCCU | 5081 |
| 1662 | 169 | UCUGUGCUCUUCGUCAUCU | AGAUGACGAAGAGCACAGA | 5082 |
| 288 | 170 | UGAUGGAGUUGGACAUGGC | GCCAUGUCCAACUCCAUCA | 5083 |
| 579 | 171 | AUGAGGGCAUGCAGAUCCC | GGGAUCUGCAUGCCCUCAU | 5084 |
| 2508 | 172 | ACUAUCCAGUUGAUGGGCU | AGCCCAUCAACUGGAUAGU | 5085 |
| 580 | 173 | UGAGGGCAUGCAGAUCCCA | UGGGAUCUGCAUGCCCUCA | 5086 |
| 2388 | 174 | UUGGAUAUCGCCAGGAUGA | UCAUCCUGGCGAUAUCCAA | 5087 |
| 2543 | 175 | GCCCAGGACCUCAUGGAUG | CAUCCAUGAGGUCCUGGGC | 5088 |
| 708 | 176 | AACUUGCCACACGUGCAAU | AUUGCACGUGUGGCAAGUU | 5089 |
| 447 | 177 | CCCAAGUCCUGUAUGAGUG | CACUCAUACAGGACUUGGG | 5090 |
| 654 | 178 | CACAGAUGCUGAAACAUGC | GCAUGUUUCAGCAUCUGUG | 5091 |
| 912 | 179 | CUGGGACCUUGCAUAACCU | AGGUUAUGCAAGGUCCCAG | 5092 |
| 1009 | 180 | AGUGGAUUCUGUGUUGUUU | AAACAACACAGAAUCCACU | 5093 |
| 1354 | 181 | AAUGCAAGCUUUAGGACUU | AAGUCCUAAAGCUUGCAUU | 5094 |
| 1969 | 182 | AGAAAUAGUUGAAGGUUGU | ACAACCUUCAACUAUUUCU | 5095 |
| 1959 | 183 | UCCGCAUGGAAGAAAUAGU | ACUAUUUCUUCCAUGCGGA | 5096 |
| 557 | 184 | GCUAUGUUCCCUGAGACAU | AUGUCUCAGGGAACAUAGC | 5097 |
| 403 | 185 | UCUGAGUGGUAAAGGCAAU | AUUGCCUUUACCACUCAGA | 5098 |
| 1356 | 186 | UGCAAGCUUUAGGACUUCA | UGAAGUCCUAAAGCUUGCA | 5099 |
| 517 | 187 | UGGACAGUAUGCAAUGACU | AGUCAUUGCAUACUGUCCA | 5100 |
| 1238 | 188 | UUAGUAAAUAUAAUGAGGA | UCCUCAUUAUAUUUACUAA | 5101 |
| 843 | 189 | CUCAGAUGGUGUCUGCUAU | AUAGCAGACACCAUCUGAG | 5102 |
| 496 | 190 | AGAACAAGUAGCUGAUAUU | AAUAUCAGCUACUUGUUCU | 5103 |
| 2387 | 191 | CUUGGAUAUCGCCAGGAUG | CAUCCUGGCGAUAUCCAAG | 5104 |
| 1660 | 192 | CAUCUGUGCUCUUCGUCAU | AUGACGAAGAGCACAGAUG | 5105 |
| 2497 | 193 | CCCUGGUGCUGACUAUCCA | UGGAUAGUCAGCACCAGGG | 5106 |
| 1870 | 194 | ACGACUAGUUCAGUUGCUU | AAGCAACUGAACUAGUCGU | 5107 |
| 2353 | 195 | UCUUGGACUUGAUAUUGGU | ACCAAUAUCAAGUCCAAGA | 5108 |
| 2401 | 196 | GGAUGAUCCUAGCUAUCGU | ACGAUAGCUAGGAUCAUCC | 5109 |
| 878 | 197 | AAUACAAAUGAUGUAGAAA | UUUCUACAUCAUUUGUAUU | 5110 |
| 647 | 198 | GAACCAUCACAGAUGCUGA | UCAGCAUCUGUGAUGGUUC | 5111 |
| 1998 | 199 | UUCACAUCCUAGCUCGGGA | UCCCGAGCUAGGAUGUGAA | 5112 |
| 588 | 200 | UGCAGAUCCCAUCUACACA | UGUGUAGAUGGGAUCUGCA | 5113 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2042 | 201 | GGACUAAAUACCAUUCCAU | AUGGAAUGGUAUUUAGUCC | 5114 |
| 855 | 202 | CUGCUAUUGUACGUACCAU | AUGGUACGUACAAUAGCAG | 5115 |
| 2038 | 203 | CAGAGGACUAAAUACCAUU | AAUGGUAUUUAGUCCUCUG | 5116 |
| 1786 | 204 | GAUAAAGGCUACUGUUGGA | UCCAACAGUAGCCUUUAUC | 5117 |
| 1501 | 205 | AGAUGAUAUAAAUGUGGUC | GACCACAUUUAUAUCAUCU | 5118 |
| 1834 | 206 | AAAUCAUGCACCUUUGCGU | ACGCAAAGGUGCAUGAUUU | 5119 |
| 1157 | 207 | ACGACAGACUGCCUUCAAA | UUUGAAGGCAGUCUGUCGU | 5120 |
| 1239 | 208 | UAGUAAAUAUAAUGAGGAC | GUCCUCAUUAUAUUUACUA | 5121 |
| 1248 | 209 | UAAUGAGGACCUAUACUUA | UAAGUAUAGGUCCUCAUUA | 5122 |
| 660 | 210 | UGCUGAAACAUGCAGUUGU | ACAACUGCAUGUUUCAGCA | 5123 |
| 285 | 211 | AUUUGAUGGAGUUGGACAU | AUGUCCAACUCCAUCAAAU | 5124 |
| 1582 | 212 | CUGCCAAGUGGGUGGUAUA | UAUACCACCCACUUGGCAG | 5125 |
| 1735 | 213 | UGGACUACCAGUUGUGGUU | AACCACAACUGGUAGUCCA | 5126 |
| 771 | 214 | UUAAUAAGGCUGCAGUUAU | AUAACUGCAGCCUUAUUAA | 5127 |
| 1060 | 215 | ACAUCAAGAAGGAGCUAAA | UUUAGCUCCUUCUUGAUGU | 5128 |
| 2390 | 216 | GGAUAUCGCCAGGAUGAUC | GAUCAUCCUGGCGAUAUCC | 5129 |
| 2186 | 217 | CUGACAGAGUUACUUCACU | AGUGAAGUAACUCUGUCAG | 5130 |
| 1632 | 218 | GUGACAGGGAAGACAUCAC | GUGAUGUCUUCCCUGUCAC | 5131 |
| 619 | 219 | UCAUCCCACUAAUGUCCAG | CUGGACAUUAGUGGGAUGA | 5132 |
| 1656 | 220 | CUGCCAUCUGUGCUCUUCG | CGAAGAGCACAGAUGGCAG | 5133 |
| 1506 | 221 | AUAUAAAUGUGGUCACCUG | CAGGUGACCACAUUUAUAU | 5134 |
| 2494 | 222 | CCACCCUGGUGCUGACUAU | AUAGUCAGCACCAGGGUGG | 5135 |
| 1666 | 223 | UGCUCUUCGUCAUCUGACC | GGUCAGAUGACGAAGAGCA | 5136 |
| 1635 | 224 | ACAGGGAAGACAUCACUGA | UCAGUGAUGUCUUCCCUGU | 5137 |
| 294 | 225 | AGUUGGACAUGGCCAUGGA | UCCAUGGCCAUGUCCAACU | 5138 |
| 641 | 226 | UUGGCUGAACCAUCACAGA | UCUGUGAUGGUUCAGCCAA | 5139 |
| 576 | 227 | UAGAUGAGGGCAUGCAGAU | AUCUGCAUGCCCUCAUCUA | 5140 |
| 577 | 228 | AGAUGAGGGCAUGCAGAUC | GAUCUGCAUGCCCUCAUCU | 5141 |
| 1661 | 229 | AUCUGUGCUCUUCGUCAUC | GAUGACGAAGAGCACAGAU | 5142 |
| 707 | 230 | GAACUUGCCACACGUGCAA | UUGCACGUGUGGCAAGUUC | 5143 |
| 1659 | 231 | CCAUCUGUGCUCUUCGUCA | UGACGAAGAGCACAGAUGG | 5144 |
| 1185 | 232 | AUGGCAACCAAGAAAGCAA | UUGCUUUCUUGGUUGCCAU | 5145 |
| 664 | 233 | GAAACAUGCAGUUGUAAAC | GUUUACAACUGCAUGUUUC | 5146 |
| 1749 | 234 | UGGUUAAGCUCUUACACCC | GGGUGUAAGAGCUUAACCA | 5147 |
| 1234 | 235 | AGCUUUAGUAAAUAUAAUG | CAUUAUAUUUACUAAAGCU | 5148 |
| 691 | 236 | CUAUCAAGAUGAUGCAGAA | UUCUGCAUCAUCUUGAUAG | 5149 |
| 1387 | 237 | AAGUCAACGUCUUGUUCAG | CUGAACAAGACGUUGACUU | 5150 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1382 | 238 | GAUCCAAGUCAACGUCUUG | CAAGACGUUGACUUGGAUC | 5151 |
| 828 | 239 | CUAUCAUGCGUUCUCCUCA | UGAGGAGAACGCAUGAUAG | 5152 |
| 1244 | 240 | AAUAUAAUGAGGACCUAUA | UAUAGGUCCUCAUUAUAUU | 5153 |
| 1304 | 241 | GUGCUAUCUGUCUGCUCUA | UAGAGCAGACAGAUAGCAC | 5154 |
| 812 | 242 | GAAGCUUCCAGACACGCUA | UAGCGUGUCUGGAAGCUUC | 5155 |
| 1558 | 243 | UAAUUAUAAGAACAAGAUG | CAUCUUGUUCUUAUAAUUA | 5156 |
| 879 | 244 | AUACAAAUGAUGUAGAAAC | GUUUCUACAUCAUUUGUAU | 5157 |
| 1311 | 245 | CUGUCUGCUCUAGUAAUAA | UUAUUACUAGAGCAGACAG | 5158 |
| 856 | 246 | UGCUAUUGUACGUACCAUG | CAUGGUACGUACAAUAGCA | 5159 |
| 1296 | 247 | UGCUGAAGGUGCUAUCUGU | ACAGAUAGCACCUUCAGCA | 5160 |
| 960 | 248 | UCUUUAAGUCUGGAGGCAU | AUGCCUCCAGACUUAAAGA | 5161 |
| 2049 | 249 | AUACCAUUCCAUUGUUUGU | ACAAACAAUGGAAUGGUAU | 5162 |
| 1791 | 250 | AGGCUACUGUUGGAUUGAU | AUCAAUCCAACAGUAGCCU | 5163 |
| 783 | 251 | CAGUUAUGGUCCAUCAGCU | AGCUGAUGGACCAUAACUG | 5164 |
| 1569 | 252 | ACAAGAUGAUGGUCUGCCA | UGGCAGACCAUCAUCUUGU | 5165 |
| 2224 | 253 | GACAUAUGCAGCUGCUGUU | AACAGCAGCUGCAUAUGUC | 5166 |
| 934 | 254 | CCAUCAUCGUGAGGGCUUA | UAAGCCCUCACGAUGAUGG | 5167 |
| 1378 | 255 | GACAGAUCCAAGUCAACGU | ACGUUGACUUGGAUCUGUC | 5168 |
| 569 | 256 | GAGACAUUAGAUGAGGGCA | UGCCCUCAUCUAAUGUCUC | 5169 |
| 1722 | 257 | UUCGCCUUCACUAUGGACU | AGUCCAUAGUGAAGGCGAA | 5170 |
| 1483 | 258 | UGUUCAGCUUCUGGGUUCA | UGAACCCAGAAGCUGAACA | 5171 |
| 2352 | 259 | AUCUUGGACUUGAUAUUGG | CCAAUAUCAAGUCCAAGAU | 5172 |
| 719 | 260 | CGUGCAAUCCCUGAACUGA | UCAGUUCAGGGAUUGCACG | 5173 |
| 762 | 261 | AGGUGGUGGUUAAUAAGGC | GCCUUAUUAACCACCACCU | 5174 |
| 599 | 262 | UCUACACAGUUUGAUGCUG | CAGCAUCAAACUGUGUAGA | 5175 |
| 1704 | 263 | AGAUGGCCCAGAAUGCAGU | ACUGCAUUCUGGGCCAUCU | 5176 |
| 2270 | 264 | CAAGAUUACAAGAAACGGC | GCCGUUUCUUGUAAUCUUG | 5177 |
| 662 | 265 | CUGAAACAUGCAGUUGUAA | UUACAACUGCAUGUUUCAG | 5178 |
| 396 | 266 | CUCCUUCUCUGAGUGGUAA | UUACCACUCAGAGAAGGAG | 5179 |
| 1199 | 267 | AGCAAGCUCAUCAUACUGG | CCAGUAUGAUGAGCUUGCU | 5180 |
| 1560 | 268 | AUUAUAAGAACAAGAUGAU | AUCAUCUUGUUCUUAUAAU | 5181 |
| 1310 | 269 | UCUGUCUGCUCUAGUAAUA | UAUUACUAGAGCAGACAGA | 5182 |
| 1233 | 270 | AAGCUUUAGUAAAUAUAAU | AUUAUAUUUACUAAAGCUU | 5183 |
| 1330 | 271 | GCCGGCUAUUGUAGAAGCU | AGCUUCUACAAUAGCCGGC | 5184 |
| 1312 | 272 | UGUCUGCUCUAGUAAUAAG | CUUAUUACUAGAGCAGACA | 5185 |
| 1556 | 273 | AAUAAUUAUAAGAACAAGA | UCUUGUUCUUAUAAUUAUU | 5186 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2438 | 274 | UAUGGCCAGGAUGCCUUGG | CCAAGGCAUCCUGGCCAUA | 5187 |
| 1826 | 275 | UGUCCCGCAAAUCAUGCAC | GUGCAUGAUUUGCGGGACA | 5188 |
| 1397 | 276 | CUUGUUCAGAACUGUCUUU | AAAGACAGUUCUGAACAAG | 5189 |
| 3181 | 277 | GCUGUGAUACGAUGCUUCA | UGAAGCAUCGUAUCACAGC | 5190 |
| 1912 | 278 | GCGCCGUACGUCCAUGGGU | ACCCAUGGACGUACGGCGC | 5191 |
| 846 | 279 | AGAUGGUGUCUGCUAUUGU | ACAAUAGCAGACACCAUCU | 5192 |
| 1404 | 280 | AGAACUGUCUUUGGACUCU | AGAGUCCAAAGACAGUUCU | 5193 |
| 586 | 281 | CAUGCAGAUCCCAUCUACA | UGUAGAUGGGAUCUGCAUG | 5194 |
| 1469 | 282 | CUCCUUGGGACUCUUGUUC | GAACAAGAGUCCCAAGGAG | 5195 |
| 380 | 283 | GGUGCCACUACCACAGCUC | GAGCUGUGGUAGUGGCACC | 5196 |
| 1345 | 284 | AGCUGGUGGAAUGCAAGCU | AGCUUGCAUUCCACCAGCU | 5197 |
| 1863 | 285 | CCAUUCCACGACUAGUUCA | UGAACUAGUCGUGGAAUGG | 5198 |
| 635 | 286 | CAGCGUUUGGCUGAACCAU | AUGGUUCAGCCAAACGCUG | 5199 |
| 959 | 287 | AUCUUUAAGUCUGGAGGCA | UGCCUCCAGACUUAAAGAU | 5200 |
| 2440 | 288 | UGGCCAGGAUGCCUUGGGU | ACCCAAGGCAUCCUGGCCA | 5201 |
| 877 | 289 | GAAUACAAAUGAUGUAGAA | UUCUACAUCAUUUGUAUUC | 5202 |
| 2556 | 290 | UGGAUGGGCUGCCUCCAGG | CCUGGAGGCAGCCCAUCCA | 5203 |
| 1916 | 291 | CGUACGUCCAUGGGUGGGA | UCCCACCCAUGGACGUACG | 5204 |
| 850 | 292 | GGUGUCUGCUAUUGUACGU | ACGUACAAUAGCAGACACC | 5205 |
| 1303 | 293 | GGUGCUAUCUGUCUGCUCU | AGAGCAGACAGAUAGCACC | 5206 |
| 1726 | 294 | CCUUCACUAUGGACUACCA | UGGUAGUCCAUAGUGAAGG | 5207 |
| 1477 | 295 | GACUCUUGUUCAGCUUCUG | CAGAAGCUGAACAAGAGUC | 5208 |
| 598 | 296 | AUCUACACAGUUUGAUGCU | AGCAUCAAACUGUGUAGAU | 5209 |
| 2062 | 297 | GUUUGUGCAGCUGCUUUAU | AUAAAGCAGCUGCACAAAC | 5210 |
| 2278 | 298 | CAAGAAACGGCUUUCAGUU | AACUGAAAGCCGUUUCUUG | 5211 |
| 1877 | 299 | GUUCAGUUGCUUGUUCGUG | CACGAACAAGCAACUGAAC | 5212 |
| 1499 | 300 | UCAGAUGAUAUAAAUGUGG | CCACAUUUAUAUCAUCUGA | 5213 |
| 1136 | 301 | AAUGUUAAAUUCUUGGCUA | UAGCCAAGAAUUUAACAUU | 5214 |
| 1494 | 302 | UGGGUUCAGAUGAUAUAAA | UUUAUAUCAUCUGAACCCA | 5215 |
| 1972 | 303 | AAUAGUUGAAGGUUGUACC | GGUACAACCUUCAACUAUU | 5216 |
| 668 | 304 | CAUGCAGUUGUAAACUUGA | UCAAGUUUACAACUGCAUG | 5217 |
| 2945 | 305 | AAUCUGAAUAAAGUGUAAC | GUUACACUUUAUUCAGAUU | 5218 |
| 2492 | 306 | CACCACCCUGGUGCUGACU | AGUCAGCACCAGGGUGGUG | 5219 |
| 293 | 307 | GAGUUGGACAUGGCCAUGG | CCAUGGCCAUGUCCAACUC | 5220 |
| 1905 | 308 | AUACCCAGCGCCGUACGUC | GACGUACGGCGCUGGGUAU | 5221 |
| 944 | 309 | GAGGGCUUACUGGCCAUCU | AGAUGGCCAGUAAGCCCUC | 5222 |
| 581 | 310 | GAGGGCAUGCAGAUCCCAU | AUGGGAUCUGCAUGCCCUC | 5223 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1454 | 311 | GAAGGGAUGGAAGGUCUCC | GGAGACCUUCCAUCCCUUC | 5224 |
| 2254 | 312 | GUCUGAGGACAAGCCACAA | UUGUGGCUUGUCCUCAGAC | 5225 |
| 1837 | 313 | UCAUGCACCUUUGCGUGAG | CUCACGCAAAGGUGCAUGA | 5226 |
| 1425 | 314 | GGAAUCUUUCAGAUGCUGC | GCAGCAUCUGAAAGAUUCC | 5227 |
| 1372 | 315 | UCACCUGACAGAUCCAAGU | ACUUGGAUCUGUCAGGUGA | 5228 |
| 1298 | 316 | CUGAAGGUGCUAUCUGUCU | AGACAGAUAGCACCUUCAG | 5229 |
| 1674 | 317 | GUCAUCUGACCAGCCGACA | UGUCGGCUGGUCAGAUGAC | 5230 |
| 1864 | 318 | CAUUCCACGACUAGUUCAG | CUGAACUAGUCGUGGAAUG | 5231 |
| 2404 | 319 | UGAUCCUAGCUAUCGUUCU | AGAACGAUAGCUAGGAUCA | 5232 |
| 1992 | 320 | GAGCCCUUCACAUCCUAGC | GCUAGGAUGUGAAGGGCUC | 5233 |
| 578 | 321 | GAUGAGGGCAUGCAGAUCC | GGAUCUGCAUGCCCUCAUC | 5234 |
| 3091 | 322 | AUGGGUAGGGUAAAUCAGU | ACUGAUUUACCCUACCCAU | 5235 |
| 720 | 323 | GUGCAAUCCCUGAACUGAC | GUCAGUUCAGGGAUUGCAC | 5236 |
| 2054 | 324 | AUUCCAUUGUUUGUGCAGC | GCUGCACAAACAAUGGAAU | 5237 |
| 374 | 325 | CAUUCUGGUGCCACUACCA | UGGUAGUGGCACCAGAAUG | 5238 |
| 868 | 326 | UACCAUGCAGAAUACAAAU | AUUUGUAUUCUGCAUGGUA | 5239 |
| 1716 | 327 | AUGCAGUUCGCCUUCACUA | UAGUGAAGGCGAACUGCAU | 5240 |
| 950 | 328 | UUACUGGCCAUCUUUAAGU | ACUUAAAGAUGGCCAGUAA | 5241 |
| 1489 | 329 | GCUUCUGGGUUCAGAUGAU | AUCAUCUGAACCCAGAAGC | 5242 |
| 1451 | 330 | CAGGAAGGGAUGGAAGGUC | GACCUUCCAUCCCUUCCUG | 5243 |
| 1181 | 331 | GCUUAUGGCAACCAAGAAA | UUUCUUGGUUGCCAUAAGC | 5244 |
| 1633 | 332 | UGACAGGGAAGACAUCACU | AGUGAUGUCUUCCCUGUCA | 5245 |
| 2394 | 333 | AUCGCCAGGAUGAUCCUAG | CUAGGAUCAUCCUGGCGAU | 5246 |
| 1322 | 334 | AGUAAUAAGCCGGCUAUUG | CAAUAGCCGGCUUAUUACU | 5247 |
| 884 | 335 | AAUGAUGUAGAAACAGCUC | GAGCUGUUUCUACAUCAUU | 5248 |
| 2255 | 336 | UCUGAGGACAAGCCACAAG | CUUGUGGCUUGUCCUCAGA | 5249 |
| 1466 | 337 | GGUCUCCUUGGGACUCUUG | CAAGAGUCCCAAGGAGACC | 5250 |
| 1399 | 338 | UGUUCAGAACUGUCUUUGG | CCAAAGACAGUUCUGAACA | 5251 |
| 378 | 339 | CUGGUGCCACUACCACAGC | GCUGUGGUAGUGGCACCAG | 5252 |
| 1921 | 340 | GUCCAUGGGUGGGACACAG | CUGUGUCCCACCCAUGGAC | 5253 |
| 1085 | 341 | GUGCGUUUAGCUGGUGGGC | GCCCACCAGCUAAACGCAC | 5254 |
| 865 | 342 | ACGUACCAUGCAGAAUACA | UGUAUUCUGCAUGGUACGU | 5255 |
| 2015 | 343 | GAUGUUCACAACCGAAUUG | CAAUUCGGUUGUGAACAUC | 5256 |
| 1195 | 344 | AGAAAGCAAGCUCAUCAUA | UAUGAUGAGCUUGCUUUCU | 5257 |
| 1484 | 345 | GUUCAGCUUCUGGGUUCAG | CUGAACCCAGAAGCUGAAC | 5258 |
| 1855 | 346 | GCAGGGUGCCAUUCCACGA | UCGUGGAAUGGCACCCUGC | 5259 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1341 | 347 | UAGAAGCUGGUGGAAUGCA | UGCAUUCCACCAGCUUCUA | 5260 |
| 1963 | 348 | CAUGGAAGAAAUAGUUGAA | UUCAACUAUUUCUUCCAUG | 5261 |
| 2362 | 349 | UGAUAUUGGUGCCCAGGGA | UCCCUGGGCACCAAUAUCA | 5262 |
| 584 | 350 | GGCAUGCAGAUCCCAUCUA | UAGAUGGGAUCUGCAUGCC | 5263 |
| 1613 | 351 | CGUACUGUCCUUCGGGCUG | CAGCCCGAAGGACAGUACG | 5264 |
| 1155 | 352 | UUACGACAGACUGCCUUCA | UGAAGGCAGUCUGUCGUAA | 5265 |
| 334 | 353 | UAGUCACUGGCAGCAACAG | CUGUUGCUGCCAGUGACUA | 5266 |
| 1031 | 354 | GCCAUUACAACUCUCCACA | UGUGGAGAGUUGUAAUGGC | 5267 |
| 1725 | 355 | GCCUUCACUAUGGACUACC | GGUAGUCCAUAGUGAAGGC | 5268 |
| 2018 | 356 | GUUCACAACCGAAUUGUUA | UAACAAUUCGGUUGUGAAC | 5269 |
| 914 | 357 | GGGACCUUGCAUAACCUUU | AAAGGUUAUGCAAGGUCCC | 5270 |
| 2264 | 358 | AAGCCACAAGAUUACAAGA | UCUUGUAAUCUUGUGGCUU | 5271 |
| 343 | 359 | GCAGCAACAGUCUUACCUG | CAGGUAAGACUGUUGCUGC | 5272 |
| 1056 | 360 | UAUUACAUCAAGAAGGAGC | GCUCCUUCUUGAUGUAAUA | 5273 |
| 772 | 361 | UAAUAAGGCUGCAGUUAUG | CAUAACUGCAGCCUUAUUA | 5274 |
| 763 | 362 | GGUGGUGGUUAAUAAGGCU | AGCCUUAUUAACCACCACC | 5275 |
| 628 | 363 | UAAUGUCCAGCGUUUGGCU | AGCCAAACGCUGGACAUUA | 5276 |
| 399 | 364 | CUUCUCUGAGUGGUAAAGG | CCUUUACCACUCAGAGAAG | 5277 |
| 1682 | 365 | ACCAGCCGACACCAAGAAG | CUUCUUGGUGUCGGCUGGU | 5278 |
| 441 | 366 | AUACCUCCCAAGUCCUGUA | UACAGGACUUGGGAGGUAU | 5279 |
| 1729 | 367 | UCACUAUGGACUACCAGUU | AACUGGUAGUCCAUAGUGA | 5280 |
| 1902 | 368 | AGGAUACCCAGCGCCGUAC | GUACGGCGCUGGGUAUCCU | 5281 |
| 1637 | 369 | AGGGAAGACAUCACUGAGC | GCUCAGUGAUGUCUUCCCU | 5282 |
| 2391 | 370 | GAUAUCGCCAGGAUGAUCC | GGAUCAUCCUGGCGAUAUC | 5283 |
| 501 | 371 | AAGUAGCUGAUAUUGAUGG | CCAUCAAUAUCAGCUACUU | 5284 |
| 1358 | 372 | CAAGCUUUAGGACUUCACC | GGUGAAGUCCUAAAGCUUG | 5285 |
| 1821 | 373 | CCCUUUGUCCCGCAAAUCA | UGAUUUGCGGGACAAAGGG | 5286 |
| 575 | 374 | UUAGAUGAGGGCAUGCAGA | UCUGCAUGCCCUCAUCUAA | 5287 |
| 528 | 375 | CAAUGACUCGAGCUCAGAG | CUCUGAGCUCGAGUCAUUG | 5288 |
| 2433 | 376 | GUGGAUAUGGCCAGGAUGC | GCAUCCUGGCCAUAUCCAC | 5289 |
| 1497 | 377 | GUUCAGAUGAUAUAAAUGU | ACAUUUAUAUCAUCUGAAC | 5290 |
| 2134 | 378 | UCAGGACAAGGAAGCUGCA | UGCAGCUUCCUUGUCCUGA | 5291 |
| 2160 | 379 | UUGAAGCUGAGGGAGCCAC | GUGGCUCCCUCAGCUUCAA | 5292 |
| 291 | 380 | UGGAGUUGGACAUGGCCAU | AUGGCCAUGUCCAACUCCA | 5293 |
| 657 | 381 | AGAUGCUGAAACAUGCAGU | ACUGCAUGUUUCAGCAUCU | 5294 |
| 1575 | 382 | UGAUGGUCUGCCAAGUGGG | CCCACUUGGCAGACCAUCA | 5295 |
| 667 | 383 | ACAUGCAGUUGUAAACUUG | CAAGUUUACAACUGCAUGU | 5296 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2190 | 384 | CAGAGUUACUUCACUCUAG | CUAGAGUGAAGUAACUCUG | 5297 |
| 532 | 385 | GACUCGAGCUCAGAGGGUA | UACCCUCUGAGCUCGAGUC | 5298 |
| 953 | 386 | CUGGCCAUCUUUAAGUCUG | CAGACUUAAAGAUGGCCAG | 5299 |
| 3188 | 387 | UACGAUGCUUCAAGAGAAA | UUUCUCUUGAAGCAUCGUA | 5300 |
| 2301 | 388 | UGACCAGCUCUCUCUUCAG | CUGAAGAGAGAGCUGGUCA | 5301 |
| 2310 | 389 | CUCUCUUCAGAACAGAGCC | GGCUCUGUUCUGAAGAGAG | 5302 |
| 2287 | 390 | GCUUUCAGUUGAGCUGACC | GGUCAGCUCAACUGAAAGC | 5303 |
| 1927 | 391 | GGGUGGGACACAGCAGCAA | UUGCUGCUGUGUCCCACCC | 5304 |
| 712 | 392 | UGCCACACGUGCAAUCCCU | AGGGAUUGCACGUGUGGCA | 5305 |
| 2121 | 393 | UCUGUGAACUUGCUCAGGA | UCCUGAGCAAGUUCACAGA | 5306 |
| 2898 | 394 | UGAGUAAUGGUGUAGAACA | UGUUCUACACCAUUACUCA | 5307 |
| 1799 | 395 | GUUGGAUUGAUUCGAAAUC | GAUUUCGAAUCAAUCCAAC | 5308 |
| 1036 | 396 | UACAACUCUCCACAACCUU | AAGGUUGUGGAGAGUUGUA | 5309 |
| 449 | 397 | CAAGUCCUGUAUGAGUGGG | CCCACUCAUACAGGACUUG | 5310 |
| 1452 | 398 | AGGAAGGGAUGGAAGGUCU | AGACCUUCCAUCCCUUCCU | 5311 |
| 1203 | 399 | AGCUCAUCAUACUGGCUAG | CUAGCCAGUAUGAUGAGCU | 5312 |
| 1357 | 400 | GCAAGCUUUAGGACUUCAC | GUGAAGUCCUAAAGCUUGC | 5313 |
| 1512 | 401 | AUGUGGUCACCUGUGCAGC | GCUGCACAGGUGACCACAU | 5314 |
| 275 | 402 | ACUCAAGCUGAUUUGAUGG | CCAUCAAAUCAGCUUGAGU | 5315 |
| 299 | 403 | GACAUGGCCAUGGAACCAG | CUGGUUCCAUGGCCAUGUC | 5316 |
| 1241 | 404 | GUAAAUAUAAUGAGGACCU | AGGUCCUCAUUAUAUUUAC | 5317 |
| 1961 | 405 | CGCAUGGAAGAAAUAGUUG | CAACUAUUUCUUCCAUGCG | 5318 |
| 1436 | 406 | GAUGCUGCAACUAAACAGG | CCUGUUUAGUUGCAGCAUC | 5319 |
| 2469 | 407 | UGAUGGAACAUGAGAUGGG | CCCAUCUCAUGUUCCAUCA | 5320 |
| 760 | 408 | CCAGGUGGUGGUUAAUAAG | CUUAUUAACCACCACCUGG | 5321 |
| 2257 | 409 | UGAGGACAAGCCACAAGAU | AUCUUGUGGCUUGUCCUCA | 5322 |
| 952 | 410 | ACUGGCCAUCUUUAAGUCU | AGACUUAAAGAUGGCCAGU | 5323 |
| 2283 | 411 | AACGGCUUUCAGUUGAGCU | AGCUCAACUGAAAGCCGUU | 5324 |
| 1794 | 412 | CUACUGUUGGAUUGAUUCG | CGAAUCAAUCCAACAGUAG | 5325 |
| 1745 | 413 | GUUGUGGUUAAGCUCUUAC | GUAAGAGCUUAACCACAAC | 5326 |
| 1211 | 414 | AUACUGGCUAGUGGUGGAC | GUCCACCACUAGCCAGUAU | 5327 |
| 2549 | 415 | GACCUCAUGGAUGGGCUGC | GCAGCCCAUCCAUGAGGUC | 5328 |
| 2007 | 416 | UAGCUCGGGAUGUUCACAA | UUGUGAACAUCCCGAGCUA | 5329 |
| 2474 | 417 | GAACAUGAGAUGGGUGGCC | GGCCACCCAUCUCAUGUUC | 5330 |
| 1712 | 418 | CAGAAUGCAGUUCGCCUUC | GAAGGCGAACUGCAUUCUG | 5331 |
| 1919 | 419 | ACGUCCAUGGGUGGGACAC | GUGUCCCACCCAUGGACGU | 5332 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1000 | 420 | UGGUUCACCAGUGGAUUCU | AGAAUCCACUGGUGAACCA | 5333 |
| 2392 | 421 | AUAUCGCCAGGAUGAUCCU | AGGAUCAUCCUGGCGAUAU | 5334 |
| 1449 | 422 | AACAGGAAGGGAUGGAAGG | CCUUCCAUCCCUUCCUGUU | 5335 |
| 2294 | 423 | GUUGAGCUGACCAGCUCUC | GAGAGCUGGUCAGCUCAAC | 5336 |
| 1135 | 424 | AAAUGUUAAAUUCUUGGCU | AGCCAAGAAUUUAACAUUU | 5337 |
| 1333 | 425 | GGCUAUUGUAGAAGCUGGU | ACCAGCUUCUACAAUAGCC | 5338 |
| 1743 | 426 | CAGUUGUGGUUAAGCUCUU | AAGAGCUUAACCACAACUG | 5339 |
| 600 | 427 | CUACACAGUUUGAUGCUGC | GCAGCAUCAAACUGUGUAG | 5340 |
| 970 | 428 | UGGAGGCAUUCCUGCCCUG | CAGGGCAGGAAUGCCUCCA | 5341 |
| 3137 | 429 | GGACAGUUUACCAGUUGCC | GGCAACUGGUAAACUGUCC | 5342 |
| 372 | 430 | UCCAUUCUGGUGCCACUAC | GUAGUGGCACCAGAAUGGA | 5343 |
| 1761 | 431 | UACACCCACCAUCCCACUG | CAGUGGGAUGGUGGGUGUA | 5344 |
| 1650 | 432 | CUGAGCCUGCCAUCUGUGC | GCACAGAUGGCAGGCUCAG | 5345 |
| 972 | 433 | GAGGCAUUCCUGCCCUGGU | ACCAGGGCAGGAAUGCCUC | 5346 |
| 1147 | 434 | CUUGGCUAUUACGACAGAC | GUCUGUCGUAAUAGCCAAG | 5347 |
| 565 | 435 | CCCUGAGACAUUAGAUGAG | CUCAUCUAAUGUCUCAGGG | 5348 |
| 525 | 436 | AUGCAAUGACUCGAGCUCA | UGAGCUCGAGUCAUUGCAU | 5349 |
| 1599 | 437 | UAGAGGCUCUUGUGCGUAC | GUACGCACAAGAGCCUCUA | 5350 |
| 2199 | 438 | UUCACUCUAGGAAUGAAGG | CCUUCAUUCCUAGAGUGAA | 5351 |
| 2261 | 439 | GACAAGCCACAAGAUUACA | UGUAAUCUUGUGGCUUGUC | 5352 |
| 705 | 440 | CAGAACUUGCCACACGUGC | GCACGUGUGGCAAGUUCUG | 5353 |
| 916 | 441 | GACCUUGCAUAACCUUUCC | GGAAAGGUUAUGCAAGGUC | 5354 |
| 385 | 442 | CACUACCACAGCUCCUUCU | AGAAGGAGCUGUGGUAGUG | 5355 |
| 3076 | 443 | CUAUUUGGGAUAUGUAUGG | CCAUACAUAUCCCAAAUAG | 5356 |
| 1396 | 444 | UCUUGUUCAGAACUGUCUU | AAGACAGUUCUGAACAAGA | 5357 |
| 2447 | 445 | GAUGCCUUGGGUAUGGACC | GGUCCAUACCCAAGGCAUC | 5358 |
| 1338 | 446 | UUGUAGAAGCUGGUGGAAU | AUUCCACCAGCUUCUACAA | 5359 |
| 2215 | 447 | AGGUGUGGCGACAUAUGCA | UGCAUAUGUCGCCACACCU | 5360 |
| 722 | 448 | GCAAUCCCUGAACUGACAA | UUGUCAGUUCAGGGAUUGC | 5361 |
| 1316 | 449 | UGCUCUAGUAAUAAGCCGG | CCGGCUUAUUACUAGAGCA | 5362 |
| 1687 | 450 | CCGACACCAAGAAGCAGAG | CUCUGCUUCUUGGUGUCGG | 5363 |
| 697 | 451 | AGAUGAUGCAGAACUUGCC | GGCAAGUUCUGCAUCAUCU | 5364 |
| 2517 | 452 | UUGAUGGGCUGCCAGAUCU | AGAUCUGGCAGCCCAUCAA | 5365 |
| 1685 | 453 | AGCCGACACCAAGAAGCAG | CUGCUUCUUGGUGUCGGCU | 5366 |
| 3090 | 454 | UAUGGGUAGGGUAAAUCAG | CUGAUUUACCCUACCCAUA | 5367 |
| 1205 | 455 | CUCAUCAUACUGGCUAGUG | CACUAGCCAGUAUGAUGAG | 5368 |
| 1153 | 456 | UAUUACGACAGACUGCCUU | AAGGCAGUCUGUCGUAAUA | 5369 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 723 | 457 | CAAUCCCUGAACUGACAAA | UUUGUCAGUUCAGGGAUUG | 5370 |
| 1468 | 458 | UCUCCUUGGGACUCUUGUU | AACAAGAGUCCCAAGGAGA | 5371 |
| 2480 | 459 | GAGAUGGGUGGCCACCACC | GGUGGUGGCCACCCAUCUC | 5372 |
| 1856 | 460 | CAGGGUGCCAUUCCACGAC | GUCGUGGAAUGGCACCCUG | 5373 |
| 2193 | 461 | AGUUACUUCACUCUAGGAA | UUCCUAGAGUGAAGUAACU | 5374 |
| 2355 | 462 | UUGGACUUGAUAUUGGUGC | GCACCAAUAUCAAGUCCAA | 5375 |
| 1995 | 463 | CCCUUCACAUCCUAGCUCG | CGAGCUAGGAUGUGAAGGG | 5376 |
| 821 | 464 | AGACACGCUAUCAUGCGUU | AACGCAUGAUAGCGUGUCU | 5377 |
| 1715 | 465 | AAUGCAGUUCGCCUUCACU | AGUGAAGGCGAACUGCAUU | 5378 |
| 1182 | 466 | CUUAUGGCAACCAAGAAAG | CUUUCUUGGUUGCCAUAAG | 5379 |
| 445 | 467 | CUCCCAAGUCCUGUAUGAG | CUCAUACAGGACUUGGGAG | 5380 |
| 1759 | 468 | CUUACACCCACCAUCCCAC | GUGGGAUGGUGGGUGUAAG | 5381 |
| 1461 | 469 | UGGAAGGUCUCCUUGGGAC | GUCCCAAGGAGACCUUCCA | 5382 |
| 1993 | 470 | AGCCCUUCACAUCCUAGCU | AGCUAGGAUGUGAAGGGCU | 5383 |
| 2558 | 471 | GAUGGGCUGCCUCCAGGUG | CACCUGGAGGCAGCCCAUC | 5384 |
| 1488 | 472 | AGCUUCUGGGUUCAGAUGA | UCAUCUGAACCCAGAAGCU | 5385 |
| 1652 | 473 | GAGCCUGCCAUCUGUGCUC | GAGCACAGAUGGCAGGCUC | 5386 |
| 963 | 474 | UUAAGUCUGGAGGCAUUCC | GGAAUGCCUCCAGACUUAA | 5387 |
| 1520 | 475 | ACCUGUGCAGCUGGAAUUC | GAAUUCCAGCUGCACAGGU | 5388 |
| 1828 | 476 | UCCCGCAAAUCAUGCACCU | AGGUGCAUGAUUUGCGGGA | 5389 |
| 2214 | 477 | AAGGUGUGGCGACAUAUGC | GCAUAUGUCGCCACACCUU | 5390 |
| 2155 | 478 | AGCUAUUGAAGCUGAGGGA | UCCCUCAGCUUCAAUAGCU | 5391 |
| 332 | 479 | GUUAGUCACUGGCAGCAAC | GUUGCUGCCAGUGACUAAC | 5392 |
| 1878 | 480 | UUCAGUUGCUUGUUCGUGC | GCACGAACAAGCAACUGAA | 5393 |
| 1573 | 481 | GAUGAUGGUCUGCCAAGUG | CACUUGGCAGACCAUCAUC | 5394 |
| 1446 | 482 | CUAAACAGGAAGGGAUGGA | UCCAUCCCUUCCUGUUUAG | 5395 |
| 1868 | 483 | CCACGACUAGUUCAGUUGC | GCAACUGAACUAGUCGUGG | 5396 |
| 1873 | 484 | ACUAGUUCAGUUGCUUGUU | AACAAGCAACUGAACUAGU | 5397 |
| 1002 | 485 | GUUCACCAGUGGAUUCUGU | ACAGAAUCCACUGGUGAAC | 5398 |
| 408 | 486 | GUGGUAAAGGCAAUCCUGA | UCAGGAUUGCCUUUACCAC | 5399 |
| 287 | 487 | UUGAUGGAGUUGGACAUGG | CCAUGUCCAACUCCAUCAA | 5400 |
| 2128 | 488 | ACUUGCUCAGGACAAGGAA | UUCCUUGUCCUGAGCAAGU | 5401 |
| 2513 | 489 | CCAGUUGAUGGGCUGCCAG | CUGGCAGCCCAUCAACUGG | 5402 |
| 1196 | 490 | GAAAGCAAGCUCAUCAUAC | GUAUGAUGAGCUUGCUUUC | 5403 |
| 572 | 491 | ACAUUAGAUGAGGGCAUGC | GCAUGCCCUCAUCUAAUGU | 5404 |
| 622 | 492 | UCCCACUAAUGUCCAGCGU | ACGCUGGACAUUAGUGGGA | 5405 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1187 | 493 | GGCAACCAAGAAAGCAAGC | GCUUGCUUUCUUGGUUGCC | 5406 |
| 1971 | 494 | AAAUAGUUGAAGGUUGUAC | GUACAACCUUCAACUAUUU | 5407 |
| 3083 | 495 | GGAUAUGUAUGGGUAGGGU | ACCCUACCCAUACAUAUCC | 5408 |
| 2944 | 496 | UAAUCUGAAUAAAGUGUAA | UUACACUUUAUUCAGAUUA | 5409 |
| 1894 | 497 | UGCACAUCAGGAUACCCAG | CUGGGUAUCCUGAUGUGCA | 5410 |
| 1323 | 498 | GUAAUAAGCCGGCUAUUGU | ACAAUAGCCGGCUUAUUAC | 5411 |
| 1202 | 499 | AAGCUCAUCAUACUGGCUA | UAGCCAGUAUGAUGAGCUU | 5412 |
| 718 | 500 | ACGUGCAAUCCCUGAACUG | CAGUUCAGGGAUUGCACGU | 5413 |
| 1744 | 501 | AGUUGUGGUUAAGCUCUUA | UAAGAGCUUAACCACAACU | 5414 |
| 756 | 502 | AGGACCAGGUGGUGGUUAA | UUAACCACCACCUGGUCCU | 5415 |
| 1317 | 503 | GCUCUAGUAAUAAGCCGGC | GCCGGCUUAUUACUAGAGC | 5416 |
| 284 | 504 | GAUUUGAUGGAGUUGGACA | UGUCCAACUCCAUCAAAUC | 5417 |
| 886 | 505 | UGAUGUAGAAACAGCUCGU | ACGAGCUGUUUCUACAUCA | 5418 |
| 2430 | 506 | CUGGUGGAUAUGGCCAGGA | UCCUGGCCAUAUCCACCAG | 5419 |
| 1207 | 507 | CAUCAUACUGGCUAGUGGU | ACCACUAGCCAGUAUGAUG | 5420 |
| 592 | 508 | GAUCCCAUCUACACAGUUU | AAACUGUGUAGAUGGGAUC | 5421 |
| 824 | 509 | CACGCUAUCAUGCGUUCUC | GAGAACGCAUGAUAGCGUG | 5422 |
| 519 | 510 | GACAGUAUGCAAUGACUCG | CGAGUCAUUGCAUACUGUC | 5423 |
| 3166 | 511 | AAGUUGUUGUAACCUGCUG | CAGCAGGUUACAACAACUU | 5424 |
| 1151 | 512 | GCUAUUACGACAGACUGCC | GGCAGUCUGUCGUAAUAGC | 5425 |
| 2566 | 513 | GCCUCCAGGUGACAGCAAU | AUUGCUGUCACCUGGAGGC | 5426 |
| 453 | 514 | UCCUGUAUGAGUGGGAACA | UGUUCCCACUCAUACAGGA | 5427 |
| 587 | 515 | AUGCAGAUCCCAUCUACAC | GUGUAGAUGGGAUCUGCAU | 5428 |
| 930 | 516 | UUUCCCAUCAUCGUGAGGG | CCCUCACGAUGAUGGGAAA | 5429 |
| 1585 | 517 | CCAAGUGGGUGGUAUAGAG | CUCUAUACCACCCACUUGG | 5430 |
| 915 | 518 | GGACCUUGCAUAACCUUUC | GAAAGGUUAUGCAAGGUCC | 5431 |
| 446 | 519 | UCCCAAGUCCUGUAUGAGU | ACUCAUACAGGACUUGGGA | 5432 |
| 1869 | 520 | CACGACUAGUUCAGUUGCU | AGCAACUGAACUAGUCGUG | 5433 |
| 1960 | 521 | CCGCAUGGAAGAAAUAGUU | AACUAUUUCUUCCAUGCGG | 5434 |
| 1708 | 522 | GGCCCAGAAUGCAGUUCGC | GCGAACUGCAUUCUGGGCC | 5435 |
| 306 | 523 | CCAUGGAACCAGACAGAAA | UUUCUGUCUGGUUCCAUGG | 5436 |
| 2281 | 524 | GAAACGGCUUUCAGUUGAG | CUCAACUGAAAGCCGUUUC | 5437 |
| 3082 | 525 | GGGAUAUGUAUGGGUAGGG | CCCUACCCAUACAUAUCCC | 5438 |
| 1473 | 526 | UUGGGACUCUUGUUCAGCU | AGCUGAACAAGAGUCCCAA | 5439 |
| 559 | 527 | UAUGUUCCUGAGACAUUA | UAAUGUCUCAGGGAACAUA | 5440 |
| 1416 | 528 | GGACUCUCAGGAAUCUUUC | GAAAGAUUCCUGAGAGUCC | 5441 |
| 2145 | 529 | AAGCUGCAGAAGCUAUUGA | UCAAUAGCUUCUGCAGCUU | 5442 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1994 | 530 | GCCCUUCACAUCCUAGCUC | GAGCUAGGAUGUGAAGGGC | 5443 |
| 1702 | 531 | AGAGAUGGCCCAGAAUGCA | UGCAUUCUGGGCCAUCUCU | 5444 |
| 417 | 532 | GCAAUCCUGAGGAAGAGGA | UCCUCUUCCUCAGGAUUGC | 5445 |
| 2444 | 533 | CAGGAUGCCUUGGGUAUGG | CCAUACCCAAGGCAUCCUG | 5446 |
| 555 | 534 | CUGCUAUGUUCCCUGAGAC | GUCUCAGGGAACAUAGCAG | 5447 |
| 2019 | 535 | UUCACAACCGAAUUGUUAU | AUAACAAUUCGGUUGUGAA | 5448 |
| 1197 | 536 | AAAGCAAGCUCAUCAUACU | AGUAUGAUGAGCUUGCUUU | 5449 |
| 415 | 537 | AGGCAAUCCUGAGGAAGAG | CUCUUCCUCAGGAUUGCCU | 5450 |
| 2061 | 538 | UGUUUGUGCAGCUGCUUUA | UAAAGCAGCUGCACAAACA | 5451 |
| 1352 | 539 | GGAAUGCAAGCUUUAGGAC | GUCCUAAAGCUUGCAUUCC | 5452 |
| 1331 | 540 | CCGGCUAUUGUAGAAGCUG | CAGCUUCUACAAUAGCCGG | 5453 |
| 1325 | 541 | AAUAAGCCGGCUAUUGUAG | CUACAAUAGCCGGCUUAUU | 5454 |
| 1486 | 542 | UCAGCUUCUGGGUUCAGAU | AUCUGAACCCAGAAGCUGA | 5455 |
| 454 | 543 | CCUGUAUGAGUGGGAACAG | CUGUUCCCACUCAUACAGG | 5456 |
| 490 | 544 | CACUCAAGAACAAGUAGCU | AGCUACUUGUUCUUGAGUG | 5457 |
| 1996 | 545 | CCUUCACAUCCUAGCUCGG | CCGAGCUAGGAUGUGAAGG | 5458 |
| 1839 | 546 | AUGCACCUUUGCGUGAGCA | UGCUCACGCAAAGGUGCAU | 5459 |
| 1888 | 547 | UGUUCGUGCACAUCAGGAU | AUCCUGAUGUGCACGAACA | 5460 |
| 1879 | 548 | UCAGUUGCUUGUUCGUGCA | UGCACGAACAAGCAACUGA | 5461 |
| 1829 | 549 | CCCGCAAAUCAUGCACCUU | AAGGUGCAUGAUUUGCGGG | 5462 |
| 281 | 550 | GCUGAUUUGAUGGAGUUGG | CCAACUCCAUCAAAUCAGC | 5463 |
| 1598 | 551 | AUAGAGGCUCUUGUGCGUA | UACGCACAAGAGCCUCUAU | 5464 |
| 2135 | 552 | CAGGACAAGGAAGCUGCAG | CUGCAGCUUCCUUGUCCUG | 5465 |
| 1755 | 553 | AGCUCUUACACCCACCAUC | GAUGGUGGGUGUAAGAGCU | 5466 |
| 651 | 554 | CAUCACAGAUGCUGAAACA | UGUUUCAGCAUCUGUGAUG | 5467 |
| 1335 | 555 | CUAUUGUAGAAGCUGGUGG | CCACCAGCUUCUACAAUAG | 5468 |
| 2541 | 556 | AUGCCCAGGACCUCAUGGA | UCCAUGAGGUCCUGGGCAU | 5469 |
| 531 | 557 | UGACUCGAGCUCAGAGGGU | ACCCUCUGAGCUCGAGUCA | 5470 |
| 606 | 558 | AGUUUGAUGCUGCUCAUCC | GGAUGAGCAGCAUCAAACU | 5471 |
| 1620 | 559 | UCCUUCGGGCUGGUGACAG | CUGUCACCAGCCCGAAGGA | 5472 |
| 2211 | 560 | AUGAAGGUGUGGCGACAUA | UAUGUCGCCACACCUUCAU | 5473 |
| 2293 | 561 | AGUUGAGCUGACCAGCUCU | AGAGCUGGUCAGCUCAACU | 5474 |
| 455 | 562 | CUGUAUGAGUGGGAACAGG | CCUGUUCCCACUCAUACAG | 5475 |
| 540 | 563 | CUCAGAGGGUACGAGCUGC | GCAGCUCGUACCCUCUGAG | 5476 |
| 416 | 564 | GGCAAUCCUGAGGAAGAGG | CCUCUUCCUCAGGAUUGCC | 5477 |
| 1210 | 565 | CAUACUGGCUAGUGGUGGA | UCCACCACUAGCCAGUAUG | 5478 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2262 | 566 | ACAAGCCACAAGAUUACAA | UUGUAAUCUUGUGGCUUGU | 5479 |
| 1604 | 567 | GCUCUUGUGCGUACUGUCC | GGACAGUACGCACAAGAGC | 5480 |
| 435 | 568 | AUGUGGAUACCUCCCAAGU | ACUUGGGAGGUAUCCACAU | 5481 |
| 2060 | 569 | UUGUUUGUGCAGCUGCUUU | AAAGCAGCUGCACAAACAA | 5482 |
| 2225 | 570 | ACAUAUGCAGCUGCUGUUU | AAACAGCAGCUGCAUAUGU | 5483 |
| 481 | 571 | UCAGUCCUUCACUCAAGAA | UUCUUGAGUGAAGGACUGA | 5484 |
| 917 | 572 | ACCUUGCAUAACCUUUCCC | GGGAAAGGUUAUGCAAGGU | 5485 |
| 2221 | 573 | GGCGACAUAUGCAGCUGCU | AGCAGCUGCAUAUGUCGCC | 5486 |
| 849 | 574 | UGGUGUCUGCUAUUGUACG | CGUACAAUAGCAGACACCA | 5487 |
| 562 | 575 | GUUCCCUGAGACAUUAGAU | AUCUAAUGUCUCAGGGAAC | 5488 |
| 1787 | 576 | AUAAAGGCUACUGUUGGAU | AUCCAACAGUAGCCUUUAU | 5489 |
| 1860 | 577 | GUGCCAUUCCACGACUAGU | ACUAGUCGUGGAAUGGCAC | 5490 |
| 1590 | 578 | UGGGUGGUAUAGAGGCUCU | AGAGCCUCUAUACCACCCA | 5491 |
| 955 | 579 | GGCCAUCUUUAAGUCUGGA | UCCAGACUUAAAGAUGGCC | 5492 |
| 2365 | 580 | UAUUGGUGCCCAGGGAGAA | UUCUCCCUGGGCACCAAUA | 5493 |
| 534 | 581 | CUCGAGCUCAGAGGGUACG | CGUACCCUCUGAGCUCGAG | 5494 |
| 706 | 582 | AGAACUUGCCACACGUGCA | UGCACGUGUGGCAAGUUCU | 5495 |
| 1740 | 583 | UACCAGUUGUGGUUAAGCU | AGCUUAACCACAACUGGUA | 5496 |
| 638 | 584 | CGUUUGGCUGAACCAUCAC | GUGAUGGUUCAGCCAAACG | 5497 |
| 1334 | 585 | GCUAUUGUAGAAGCUGGUG | CACCAGCUUCUACAAUAGC | 5498 |
| 971 | 586 | GGAGGCAUUCCUGCCCUGG | CCAGGGCAGGAAUGCCUCC | 5499 |
| 2493 | 587 | ACCACCCUGGUGCUGACUA | UAGUCAGCACCAGGGUGGU | 5500 |
| 1814 | 588 | AAUCUUGCCCUUUGUCCCG | CGGGACAAAGGGCAAGAUU | 5501 |
| 1088 | 589 | CGUUUAGCUGGUGGGCUGC | GCAGCCCACCAGCUAAACG | 5502 |
| 2292 | 590 | CAGUUGAGCUGACCAGCUC | GAGCUGGUCAGCUCAACUG | 5503 |
| 1504 | 591 | UGAUAUAAAUGUGGUCACC | GGUGACCACAUUUAUAUCA | 5504 |
| 404 | 592 | CUGAGUGGUAAAGGCAAUC | GAUUGCCUUUACCACUCAG | 5505 |
| 1301 | 593 | AAGGUGCUAUCUGUCUGCU | AGCAGACAGAUAGCACCUU | 5506 |
| 2004 | 594 | UCCUAGCUCGGGAUGUUCA | UGAACAUCCCGAGCUAGGA | 5507 |
| 277 | 595 | UCAAGCUGAUUUGAUGGAG | CUCCAUCAAAUCAGCUUGA | 5508 |
| 2304 | 596 | CCAGCUCUCUCUUCAGAAC | GUUCUGAAGAGAGAGCUGG | 5509 |
| 300 | 597 | ACAUGGCCAUGGAACCAGA | UCUGGUUCCAUGGCCAUGU | 5510 |
| 1906 | 598 | UACCCAGCGCCGUACGUCC | GGACGUACGGCGCUGGGUA | 5511 |
| 1973 | 599 | AUAGUUGAAGGUUGUACCG | CGGUACAACCUUCAACUAU | 5512 |
| 1360 | 600 | AGCUUUAGGACUUCACCUG | CAGGUGAAGUCCUAAAGCU | 5513 |
| 2094 | 601 | ACAUCCAAAGAGUAGCUGC | GCAGCUACUCUUUGGAUGU | 5514 |
| 920 | 602 | UUGCAUAACCUUUCCCAUC | GAUGGGAAAGGUUAUGCAA | 5515 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1707 | 603 | UGGCCCAGAAUGCAGUUCG | CGAACUGCAUUCUGGGCCA | 5516 |
| 1808 | 604 | AUUCGAAAUCUUGCCCUUU | AAAGGGCAAGAUUUCGAAU | 5517 |
| 1326 | 605 | AUAAGCCGGCUAUUGUAGA | UCUACAAUAGCCGGCUUAU | 5518 |
| 1158 | 606 | CGACAGACUGCCUUCAAAU | AUUUGAAGGCAGUCUGUCG | 5519 |
| 781 | 607 | UGCAGUUAUGGUCCAUCAG | CUGAUGGACCAUAACUGCA | 5520 |
| 607 | 608 | GUUUGAUGCUGCUCAUCCC | GGGAUGAGCAGCAUCAAAC | 5521 |
| 627 | 609 | CUAAUGUCCAGCGUUUGGC | GCCAAACGCUGGACAUUAG | 5522 |
| 500 | 610 | CAAGUAGCUGAUAUUGAUG | CAUCAAUAUCAGCUACUUG | 5523 |
| 2185 | 611 | UCUGACAGAGUUACUUCAC | GUGAAGUAACUCUGUCAGA | 5524 |
| 1592 | 612 | GGUGGUAUAGAGGCUCUUG | CAAGAGCCUCUAUACCACC | 5525 |
| 758 | 613 | GACCAGGUGGUGGUUAAUA | UAUUAACCACCACCUGGUC | 5526 |
| 2551 | 614 | CCUCAUGGAUGGGCUGCCU | AGGCAGCCCAUCCAUGAGG | 5527 |
| 1409 | 615 | UGUCUUUGGACUCUCAGGA | UCCUGAGAGUCCAAAGACA | 5528 |
| 497 | 616 | GAACAAGUAGCUGAUAUUG | CAAUAUCAGCUACUUGUUC | 5529 |
| 381 | 617 | GUGCCACUACCACAGCUCC | GGAGCUGUGGUAGUGGCAC | 5530 |
| 1841 | 618 | GCACCUUUGCGUGAGCAGG | CCUGCUCACGCAAAGGUGC | 5531 |
| 1368 | 619 | GACUUCACCUGACAGAUCC | GGAUCUGUCAGGUGAAGUC | 5532 |
| 2047 | 620 | AAAUACCAUUCCAUUGUUU | AAACAAUGGAAUGGUAUUU | 5533 |
| 492 | 621 | CUCAAGAACAAGUAGCUGA | UCAGCUACUUGUUCUUGAG | 5534 |
| 2118 | 622 | UCCUCUGUGAACUUGCUCA | UGAGCAAGUUCACAGAGGA | 5535 |
| 968 | 623 | UCUGGAGGCAUUCCUGCCC | GGGCAGGAAUGCCUCCAGA | 5536 |
| 965 | 624 | AAGUCUGGAGGCAUUCCUG | CAGGAAUGCCUCCAGACUU | 5537 |
| 1977 | 625 | UUGAAGGUUGUACCGGAGC | GCUCCGGUACAACCUUCAA | 5538 |
| 2001 | 626 | ACAUCCUAGCUCGGGAUGU | ACAUCCCGAGCUAGGAUGU | 5539 |
| 1191 | 627 | ACCAAGAAAGCAAGCUCAU | AUGAGCUUGCUUUCUUGGU | 5540 |
| 640 | 628 | UUUGGCUGAACCAUCACAG | CUGUGAUGGUUCAGCCAAA | 5541 |
| 715 | 629 | CACACGUGCAAUCCCUGAA | UUCAGGGAUUGCACGUGUG | 5542 |
| 1204 | 630 | GCUCAUCAUACUGGCUAGU | ACUAGCCAGUAUGAUGAGC | 5543 |
| 3093 | 631 | GGGUAGGGUAAAUCAGUAA | UUACUGAUUUACCCUACCC | 5544 |
| 1371 | 632 | UUCACCUGACAGAUCCAAG | CUUGGAUCUGUCAGGUGAA | 5545 |
| 409 | 633 | UGGUAAAGGCAAUCCUGAG | CUCAGGAUUGCCUUUACCA | 5546 |
| 2405 | 634 | GAUCCUAGCUAUCGUUCUU | AAGAACGAUAGCUAGGAUC | 5547 |
| 1671 | 635 | UUCGUCAUCUGACCAGCCG | CGGCUGGUCAGAUGACGAA | 5548 |
| 1427 | 636 | AAUCUUUCAGAUGCUGCAA | UUGCAGCAUCUGAAAGAUU | 5549 |
| 1717 | 637 | UGCAGUUCGCCUUCACUAU | AUAGUGAAGGCGAACUGCA | 5550 |
| 2400 | 638 | AGGAUGAUCCUAGCUAUCG | CGAUAGCUAGGAUCAUCCU | 5551 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2305 | 639 | CAGCUCUCUCUUCAGAACA | UGUUCUGAAGAGAGAGCUG | 5552 |
| 1928 | 640 | GGUGGGACACAGCAGCAAU | AUUGCUGCUGUGUCCCACC | 5553 |
| 2399 | 641 | CAGGAUGAUCCUAGCUAUC | GAUAGCUAGGAUCAUCCUG | 5554 |
| 426 | 642 | AGGAAGAGGAUGUGGAUAC | GUAUCCACAUCCUCUUCCU | 5555 |
| 1309 | 643 | AUCUGUCUGCUCUAGUAAU | AUUACUAGAGCAGACAGAU | 5556 |
| 925 | 644 | UAACCUUUCCCAUCAUCGU | ACGAUGAUGGGAAAGGUUA | 5557 |
| 2072 | 645 | CUGCUUUAUUCUCCCAUUG | CAAUGGGAGAAUAAAGCAG | 5558 |
| 2939 | 646 | AAUUGUAAUCUGAAUAAAG | CUUUAUUCAGAUUACAAUU | 5559 |
| 1480 | 647 | UCUUGUUCAGCUUCUGGGU | ACCCAGAAGCUGAACAAGA | 5560 |
| 1889 | 648 | GUUCGUGCACAUCAGGAUA | UAUCCUGAUGUGCACGAAC | 5561 |
| 699 | 649 | AUGAUGCAGAACUUGCCAC | GUGGCAAGUUCUGCAUCAU | 5562 |
| 506 | 650 | GCUGAUAUUGAUGGACAGU | ACUGUCCAUCAAUAUCAGC | 5563 |
| 1750 | 651 | GGUUAAGCUCUUACACCCA | UGGGUGUAAGAGCUUAACC | 5564 |
| 1820 | 652 | GCCCUUUGUCCCGCAAAUC | GAUUUGCGGGACAAAGGGC | 5565 |
| 541 | 653 | UCAGAGGGUACGAGCUGCU | AGCAGCUCGUACCCUCUGA | 5566 |
| 665 | 654 | AAACAUGCAGUUGUAAACU | AGUUUACAACUGCAUGUUU | 5567 |
| 1817 | 655 | CUUGCCCUUUGUCCCGCAA | UUGCGGGACAAAGGGCAAG | 5568 |
| 2275 | 656 | UUACAAGAAACGGCUUUCA | UGAAAGCCGUUUCUUGUAA | 5569 |
| 2426 | 657 | CACUCUGGUGGAUAUGGCC | GGCCAUAUCCACCAGAGUG | 5570 |
| 958 | 658 | CAUCUUUAAGUCUGGAGGC | GCCUCCAGACUUAAAGAUG | 5571 |
| 1657 | 659 | UGCCAUCUGUGCUCUUCGU | ACGAAGAGCACAGAUGGCA | 5572 |
| 1146 | 660 | UCUUGGCUAUUACGACAGA | UCUGUCGUAAUAGCCAAGA | 5573 |
| 3078 | 661 | AUUUGGGAUAUGUAUGGGU | ACCCAUACAUAUCCCAAAU | 5574 |
| 1008 | 662 | CAGUGGAUUCUGUGUUGUU | AACAACACAGAAUCCACUG | 5575 |
| 1621 | 663 | CCUUCGGGCUGGUGACAGG | CCUGUCACCAGCCCGAAGG | 5576 |
| 1932 | 664 | GGACACAGCAGCAAUUUGU | ACAAAUUGCUGCUGUGUCC | 5577 |
| 1909 | 665 | CCAGCGCCGUACGUCCAUG | CAUGGACGUACGGCGCUGG | 5578 |
| 2279 | 666 | AAGAAACGGCUUUCAGUUG | CAACUGAAAGCCGUUUCUU | 5579 |
| 574 | 667 | AUUAGAUGAGGGCAUGCAG | CUGCAUGCCCUCAUCUAAU | 5580 |
| 2303 | 668 | ACCAGCUCUCUCUUCAGAA | UUCUGAAGAGAGAGCUGGU | 5581 |
| 784 | 669 | AGUUAUGGUCCAUCAGCUU | AAGCUGAUGGACCAUAACU | 5582 |
| 2507 | 670 | GACUAUCCAGUUGAUGGGC | GCCCAUCAACUGGAUAGUC | 5583 |
| 995 | 671 | AUGCUUGGUUCACCAGUGG | CCACUGGUGAACCAAGCAU | 5584 |
| 2006 | 672 | CUAGCUCGGGAUGUUCACA | UGUGAACAUCCCGAGCUAG | 5585 |
| 1757 | 673 | CUCUUACACCCACCAUCCC | GGGAUGGUGGGUGUAAGAG | 5586 |
| 2129 | 674 | CUUGCUCAGGACAAGGAAG | CUUCCUUGUCCUGAGCAAG | 5587 |
| 2272 | 675 | AGAUUACAAGAAACGGCUU | AAGCCGUUUCUUGUAAUCU | 5588 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 389 | 676 | ACCACAGCUCCUUCUCUGA | UCAGAGAAGGAGCUGUGGU | 5589 |
| 1435 | 677 | AGAUGCUGCAACUAAACAG | CUGUUUAGUUGCAGCAUCU | 5590 |
| 1752 | 678 | UUAAGCUCUUACACCCACC | GGUGGGUGUAAGAGCUUAA | 5591 |
| 773 | 679 | AAUAAGGCUGCAGUUAUGG | CCAUAACUGCAGCCUUAUU | 5592 |
| 3080 | 680 | UUGGGAUAUGUAUGGGUAG | CUACCCAUACAUAUCCCAA | 5593 |
| 3174 | 681 | GUAACCUGCUGUGAUACGA | UCGUAUCACAGCAGGUUAC | 5594 |
| 1578 | 682 | UGGUCUGCCAAGUGGGUGG | CCACCCACUUGGCAGACCA | 5595 |
| 398 | 683 | CCUUCUCUGAGUGGUAAAG | CUUUACCACUCAGAGAAGG | 5596 |
| 2153 | 684 | GAAGCUAUUGAAGCUGAGG | CCUCAGCUUCAAUAGCUUC | 5597 |
| 702 | 685 | AUGCAGAACUUGCCACACG | CGUGUGGCAAGUUCUGCAU | 5598 |
| 503 | 686 | GUAGCUGAUAUUGAUGGAC | GUCCAUCAAUAUCAGCUAC | 5599 |
| 276 | 687 | CUCAAGCUGAUUUGAUGGA | UCCAUCAAAUCAGCUUGAG | 5600 |
| 1962 | 688 | GCAUGGAAGAAAUAGUUGA | UCAACUAUUUCUUCCAUGC | 5601 |
| 1347 | 689 | CUGGUGGAAUGCAAGCUUU | AAAGCUUGCAUUCCACCAG | 5602 |
| 2544 | 690 | CCCAGGACCUCAUGGAUGG | CCAUCCAUGAGGUCCUGGG | 5603 |
| 3079 | 691 | UUUGGGAUAUGUAUGGGUA | UACCCAUACAUAUCCCAAA | 5604 |
| 3164 | 692 | CAAAGUUGUUGUAACCUGC | GCAGGUUACAACAACUUUG | 5605 |
| 2026 | 693 | CCGAAUUGUUAUCAGAGGA | UCCUCUGAUAACAAUUCGG | 5606 |
| 2938 | 694 | UAAUUGUAAUCUGAAUAAA | UUUAUUCAGAUUACAAUUA | 5607 |
| 2940 | 695 | AUUGUAAUCUGAAUAAAGU | ACUUUAUUCAGAUUACAAU | 5608 |
| 2027 | 696 | CGAAUUGUUAUCAGAGGAC | GUCCUCUGAUAACAAUUCG | 5609 |
| 448 | 697 | CCAAGUCCUGUAUGAGUGG | CCACUCAUACAGGACUUGG | 5610 |
| 1328 | 698 | AAGCCGGCUAUUGUAGAAG | CUUCUACAAUAGCCGGCUU | 5611 |
| 2406 | 699 | AUCCUAGCUAUCGUUCUUU | AAAGAACGAUAGCUAGGAU | 5612 |
| 924 | 700 | AUAACCUUUCCCAUCAUCG | CGAUGAUGGGAAAGGUUAU | 5613 |
| 1584 | 701 | GCCAAGUGGGUGGUAUAGA | UCUAUACCACCCACUUGGC | 5614 |
| 1871 | 702 | CGACUAGUUCAGUUGCUUG | CAAGCAACUGAACUAGUCG | 5615 |
| 999 | 703 | UUGGUUCACCAGUGGAUUC | GAAUCCACUGGUGAACCAA | 5616 |
| 1400 | 704 | GUUCAGAACUGUCUUUGGA | UCCAAAGACAGUUCUGAAC | 5617 |
| 3180 | 705 | UGCUGUGAUACGAUGCUUC | GAAGCAUCGUAUCACAGCA | 5618 |
| 2569 | 706 | UCCAGGUGACAGCAAUCAG | CUGAUUGCUGUCACCUGGA | 5619 |
| 787 | 707 | UAUGGUCCAUCAGCUUUCU | AGAAAGCUGAUGGACCAUA | 5620 |
| 1861 | 708 | UGCCAUUCCACGACUAGUU | AACUAGUCGUGGAAUGGCA | 5621 |
| 1190 | 709 | AACCAAGAAAGCAAGCUCA | UGAGCUUGCUUUCUUGGUU | 5622 |
| 1557 | 710 | AUAAUUAUAAGAACAAGAU | AUCUUGUUCUUAUAAUUAU | 5623 |
| 1751 | 711 | GUUAAGCUCUUACACCCAC | GUGGGUGUAAGAGCUUAAC | 5624 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2897 | 712 | UUGAGUAAUGGUGUAGAAC | GUUCUACACCAUUACUCAA | 5625 |
| 2217 | 713 | GUGUGGCGACAUAUGCAGC | GCUGCAUAUGUCGCCACAC | 5626 |
| 2302 | 714 | GACCAGCUCUCUCUUCAGA | UCUGAAGAGAGAGCUGGUC | 5627 |
| 1984 | 715 | UUGUACCGGAGCCCUUCAC | GUGAAGGGCUCCGGUACAA | 5628 |
| 302 | 716 | AUGGCCAUGGAACCAGACA | UGUCUGGUUCCAUGGCCAU | 5629 |
| 2431 | 717 | UGGUGGAUAUGGCCAGGAU | AUCCUGGCCAUAUCCACCA | 5630 |
| 2183 | 718 | CCUCUGACAGAGUUACUUC | GAAGUAACUCUGUCAGAGG | 5631 |
| 2403 | 719 | AUGAUCCUAGCUAUCGUUC | GAACGAUAGCUAGGAUCAU | 5632 |
| 788 | 720 | AUGGUCCAUCAGCUUUCUA | UAGAAAGCUGAUGGACCAU | 5633 |
| 1476 | 721 | GGACUCUUGUUCAGCUUCU | AGAAGCUGAACAAGAGUCC | 5634 |
| 827 | 722 | GCUAUCAUGCGUUCUCCUC | GAGGAGAACGCAUGAUAGC | 5635 |
| 2299 | 723 | GCUGACCAGCUCUCUCUUC | GAAGAGAGAGCUGGUCAGC | 5636 |
| 1891 | 724 | UCGUGCACAUCAGGAUACC | GGUAUCCUGAUGUGCACGA | 5637 |
| 2196 | 725 | UACUUCACUCUAGGAAUGA | UCAUUCCUAGAGUGAAGUA | 5638 |
| 663 | 726 | UGAAACAUGCAGUUGUAAA | UUUACAACUGCAUGUUUCA | 5639 |
| 1028 | 727 | UAUGCCAUUACAACUCUCC | GGAGAGUUGUAAUGGCAUA | 5640 |
| 2032 | 728 | UGUUAUCAGAGGACUAAAU | AUUUAGUCCUCUGAUAACA | 5641 |
| 1459 | 729 | GAUGGAAGGUCUCCUUGGG | CCCAAGGAGACCUUCCAUC | 5642 |
| 2095 | 730 | CAUCCAAAGAGUAGCUGCA | UGCAGCUACUCUUUGGAUG | 5643 |
| 1686 | 731 | GCCGACACCAAGAAGCAGA | UCUGCUUCUUGGUGUCGGC | 5644 |
| 1412 | 732 | CUUUGGACUCUCAGGAAUC | GAUUCCUGAGAGUCCAAAG | 5645 |
| 2473 | 733 | GGAACAUGAGAUGGGUGGC | GCCACCCAUCUCAUGUUCC | 5646 |
| 1080 | 734 | UGGCAGUGCGUUUAGCUGG | CCAGCUAAACGCACUGCCA | 5647 |
| 2143 | 735 | GGAAGCUGCAGAAGCUAUU | AAUAGCUUCUGCAGCUUCC | 5648 |
| 2203 | 736 | CUCUAGGAAUGAAGGUGUG | CACACCUUCAUUCCUAGAG | 5649 |
| 548 | 737 | GUACGAGCUGCUAUGUUCC | GGAACAUAGCAGCUCGUAC | 5650 |
| 1867 | 738 | UCCACGACUAGUUCAGUUG | CAACUGAACUAGUCGUGGA | 5651 |
| 842 | 739 | CCUCAGAUGGUGUCUGCUA | UAGCAGACACCAUCUGAGG | 5652 |
| 2120 | 740 | CUCUGUGAACUUGCUCAGG | CCUGAGCAAGUUCACAGAG | 5653 |
| 782 | 741 | GCAGUUAUGGUCCAUCAGC | GCUGAUGGACCAUAACUGC | 5654 |
| 1758 | 742 | UCUUACACCCACCAUCCCA | UGGGAUGGUGGGUGUAAGA | 5655 |
| 2396 | 743 | CGCCAGGAUGAUCCUAGCU | AGCUAGGAUCAUCCUGGCG | 5656 |
| 1373 | 744 | CACCUGACAGAUCCAAGUC | GACUUGGAUCUGUCAGGUG | 5657 |
| 1518 | 745 | UCACCUGUGCAGCUGGAAU | AUUCCAGCUGCACAGGUGA | 5658 |
| 2557 | 746 | GGAUGGGCUGCCUCCAGGU | ACCUGGAGGCAGCCCAUCC | 5659 |
| 1987 | 747 | UACCGGAGCCCUUCACAUC | GAUGUGAAGGGCUCCGGUA | 5660 |
| 568 | 748 | UGAGACAUUAGAUGAGGGC | GCCCUCAUCUAAUGUCUCA | 5661 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2201 | 749 | CACUCUAGGAAUGAAGGUG | CACCUUCAUUCCUAGAGUG | 5662 |
| 609 | 750 | UUGAUGCUGCUCAUCCCAC | GUGGGAUGAGCAGCAUCAA | 5663 |
| 400 | 751 | UUCUCUGAGUGGUAAAGGC | GCCUUUACCACUCAGAGAA | 5664 |
| 331 | 752 | UGUUAGUCACUGGCAGCAA | UUGCUGCCAGUGACUAACA | 5665 |
| 1967 | 753 | GAAGAAAUAGUUGAAGGUU | AACCUUCAACUAUUUCUUC | 5666 |
| 2198 | 754 | CUUCACUCUAGGAAUGAAG | CUUCAUUCCUAGAGUGAAG | 5667 |
| 1493 | 755 | CUGGGUUCAGAUGAUAUAA | UUAUAUCAUCUGAACCCAG | 5668 |
| 2260 | 756 | GGACAAGCCACAAGAUUAC | GUAAUCUUGUGGCUUGUCC | 5669 |
| 2496 | 757 | ACCCUGGUGCUGACUAUCC | GGAUAGUCAGCACCAGGGU | 5670 |
| 2361 | 758 | UUGAUAUUGGUGCCCAGGG | CCCUGGGCACCAAUAUCAA | 5671 |
| 443 | 759 | ACCUCCCAAGUCCUGUAUG | CAUACAGGACUUGGGAGGU | 5672 |
| 523 | 760 | GUAUGCAAUGACUCGAGCU | AGCUCGAGUCAUUGCAUAC | 5673 |
| 1742 | 761 | CCAGUUGUGGUUAAGCUCU | AGAGCUUAACCACAACUGG | 5674 |
| 530 | 762 | AUGACUCGAGCUCAGAGGG | CCCUCUGAGCUCGAGUCAU | 5675 |
| 3169 | 763 | UUGUUGUAACCUGCUGUGA | UCACAGCAGGUUACAACAA | 5676 |
| 1385 | 764 | CCAAGUCAACGUCUUGUUC | GAACAAGACGUUGACUUGG | 5677 |
| 2036 | 765 | AUCAGAGGACUAAAUACCA | UGGUAUUUAGUCCUCUGAU | 5678 |
| 3088 | 766 | UGUAUGGGUAGGGUAAAUC | GAUUUACCCUACCCAUACA | 5679 |
| 1850 | 767 | CGUGAGCAGGGUGCCAUUC | GAAUGGCACCCUGCUCACG | 5680 |
| 2518 | 768 | UGAUGGGCUGCCAGAUCUG | CAGAUCUGGCAGCCCAUCA | 5681 |
| 1886 | 769 | CUUGUUCGUGCACAUCAGG | CCUGAUGUGCACGAACAAG | 5682 |
| 650 | 770 | CCAUCACAGAUGCUGAAAC | GUUUCAGCAUCUGUGAUGG | 5683 |
| 3139 | 771 | ACAGUUUACCAGUUGCCUU | AAGGCAACUGGUAAACUGU | 5684 |
| 2025 | 772 | ACCGAAUUGUUAUCAGAGG | CCUCUGAUAACAAUUCGGU | 5685 |
| 1082 | 773 | GCAGUGCGUUUAGCUGGUG | CACCAGCUAAACGCACUGC | 5686 |
| 2475 | 774 | AACAUGAGAUGGGUGGCCA | UGGCCACCCAUCUCAUGUU | 5687 |
| 1375 | 775 | CCUGACAGAUCCAAGUCAA | UUGACUUGGAUCUGUCAGG | 5688 |
| 2013 | 776 | GGGAUGUUCACAACCGAAU | AUUCGGUUGUGAACAUCCC | 5689 |
| 1802 | 777 | GGAUUGAUUCGAAAUCUUG | CAAGAUUUCGAAUCAAUCC | 5690 |
| 2144 | 778 | GAAGCUGCAGAAGCUAUUG | CAAUAGCUUCUGCAGCUUC | 5691 |
| 529 | 779 | AAUGACUCGAGCUCAGAGG | CCUCUGAGCUCGAGUCAUU | 5692 |
| 1482 | 780 | UUGUUCAGCUUCUGGGUUC | GAACCCAGAAGCUGAACAA | 5693 |
| 1546 | 781 | CCUCACUUGCAAUAAUUAU | AUAAUUAUUGCAAGUGAGG | 5694 |
| 845 | 782 | CAGAUGGUGUCUGCUAUUG | CAAUAGCAGACACCAUCUG | 5695 |
| 487 | 783 | CUUCACUCAAGAACAAGUA | UACUUGUUCUUGAGUGAAG | 5696 |
| 652 | 784 | AUCACAGAUGCUGAAACAU | AUGUUUCAGCAUCUGUGAU | 5697 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1720 | 785 | AGUUCGCCUUCACUAUGGA | UCCAUAGUGAAGGCGAACU | 5698 |
| 951 | 786 | UACUGGCCAUCUUUAAGUC | GACUUAAAGAUGGCCAGUA | 5699 |
| 1232 | 787 | CAAGCUUUAGUAAAUAUAA | UUAUAUUUACUAAAGCUUG | 5700 |
| 2265 | 788 | AGCCACAAGAUUACAAGAA | UUCUUGUAAUCUUGUGGCU | 5701 |
| 1698 | 789 | AAGCAGAGAUGGCCCAGAA | UUCUGGGCCAUCUCUGCUU | 5702 |
| 701 | 790 | GAUGCAGAACUUGCCACAC | GUGUGGCAAGUUCUGCAUC | 5703 |
| 1428 | 791 | AUCUUUCAGAUGCUGCAAC | GUUGCAGCAUCUGAAAGAU | 5704 |
| 1930 | 792 | UGGGACACAGCAGCAAUUU | AAAUUGCUGCUGUGUCCCA | 5705 |
| 1379 | 793 | ACAGAUCCAAGUCAACGUC | GACGUUGACUUGGAUCUGU | 5706 |
| 1936 | 794 | ACAGCAGCAAUUUGUGGAG | CUCCACAAAUUGCUGCUGU | 5707 |
| 1441 | 795 | UGCAACUAAACAGGAAGGG | CCCUUCCUGUUUAGUUGCA | 5708 |
| 2132 | 796 | GCUCAGGACAAGGAAGCUG | CAGCUUCCUUGUCCUGAGC | 5709 |
| 2043 | 797 | GACUAAAUACCAUUCCAUU | AAUGGAAUGGUAUUUAGUC | 5710 |
| 608 | 798 | UUUGAUGCUGCUCAUCCCA | UGGGAUGAGCAGCAUCAAA | 5711 |
| 341 | 799 | UGGCAGCAACAGUCUUACC | GGUAAGACUGUUGCUGCCA | 5712 |
| 1194 | 800 | AAGAAAGCAAGCUCAUCAU | AUGAUGAGCUUGCUUUCUU | 5713 |
| 2350 | 801 | UGAUCUUGGACUUGAUAUU | AAUAUCAAGUCCAAGAUCA | 5714 |
| 2948 | 802 | CUGAAUAAAGUGUAACAAU | AUUGUUACACUUUAUUCAG | 5715 |
| 2044 | 803 | ACUAAAUACCAUUCCAUUG | CAAUGGAAUGGUAUUUAGU | 5716 |
| 621 | 804 | AUCCCACUAAUGUCCAGCG | CGCUGGACAUUAGUGGGAU | 5717 |
| 384 | 805 | CCACUACCACAGCUCCUUC | GAAGGAGCUGUGGUAGUGG | 5718 |
| 1898 | 806 | CAUCAGGAUACCCAGCGCC | GGCGCUGGGUAUCCUGAUG | 5719 |
| 653 | 807 | UCACAGAUGCUGAAACAUG | CAUGUUUCAGCAUCUGUGA | 5720 |
| 1846 | 808 | UUUGCGUGAGCAGGGUGCC | GGCACCCUGCUCACGCAAA | 5721 |
| 2348 | 809 | GCUGAUCUUGGACUUGAUA | UAUCAAGUCCAAGAUCAGC | 5722 |
| 1150 | 810 | GGCUAUUACGACAGACUGC | GCAGUCUGUCGUAAUAGCC | 5723 |
| 298 | 811 | GGACAUGGCCAUGGAACCA | UGGUUCCAUGGCCAUGUCC | 5724 |
| 1568 | 812 | AACAAGAUGAUGGUCUGCC | GGCAGACCAUCAUCUUGUU | 5725 |
| 1058 | 813 | UUACAUCAAGAAGGAGCUA | UAGCUCCUUCUUGAUGUAA | 5726 |
| 1835 | 814 | AAUCAUGCACCUUUGCGUG | CACGCAAAGGUGCAUGAUU | 5727 |
| 1832 | 815 | GCAAAUCAUGCACCUUUGC | GCAAAGGUGCAUGAUUUGC | 5728 |
| 406 | 816 | GAGUGGUAAAGGCAAUCCU | AGGAUUGCCUUUACCACUC | 5729 |
| 1723 | 817 | UCGCCUUCACUAUGGACUA | UAGUCCAUAGUGAAGGCGA | 5730 |
| 371 | 818 | AUCCAUUCUGGUGCCACUA | UAGUGGCACCAGAAUGGAU | 5731 |
| 1899 | 819 | AUCAGGAUACCCAGCGCCG | CGGCGCUGGGUAUCCUGAU | 5732 |
| 522 | 820 | AGUAUGCAAUGACUCGAGC | GCUCGAGUCAUUGCAUACU | 5733 |
| 2285 | 821 | CGGCUUUCAGUUGAGCUGA | UCAGCUCAACUGAAAGCCG | 5734 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 779 | 822 | GCUGCAGUUAUGGUCCAUC | GAUGGACCAUAACUGCAGC | 5735 |
| 2896 | 823 | AUUGAGUAAUGGUGUAGAA | UUCUACACCAUUACUCAAU | 5736 |
| 2943 | 824 | GUAAUCUGAAUAAAGUGUA | UACACUUUAUUCAGAUUAC | 5737 |
| 513 | 825 | UUGAUGGACAGUAUGCAAU | AUUGCAUACUGUCCAUCAA | 5738 |
| 3084 | 826 | GAUAUGUAUGGGUAGGGUA | UACCCUACCCAUACAUAUC | 5739 |
| 1567 | 827 | GAACAAGAUGAUGGUCUGC | GCAGACCAUCAUCUUGUUC | 5740 |
| 2034 | 828 | UUAUCAGAGGACUAAAUAC | GUAUUUAGUCCUCUGAUAA | 5741 |
| 1003 | 829 | UUCACCAGUGGAUUCUGUG | CACAGAAUCCACUGGUGAA | 5742 |
| 1980 | 830 | AAGGUUGUACCGGAGCCCU | AGGGCUCCGGUACAACCUU | 5743 |
| 1340 | 831 | GUAGAAGCUGGUGGAAUGC | GCAUUCCACCAGCUUCUAC | 5744 |
| 1437 | 832 | AUGCUGCAACUAAACAGGA | UCCUGUUUAGUUGCAGCAU | 5745 |
| 2425 | 833 | UCACUCUGGUGGAUAUGGC | GCCAUAUCCACCAGAGUGA | 5746 |
| 282 | 834 | CUGAUUUGAUGGAGUUGGA | UCCAACUCCAUCAAAUCAG | 5747 |
| 1206 | 835 | UCAUCAUACUGGCUAGUGG | CCACUAGCCAGUAUGAUGA | 5748 |
| 1885 | 836 | GCUUGUUCGUGCACAUCAG | CUGAUGUGCACGAACAAGC | 5749 |
| 1314 | 837 | UCUGCUCUAGUAAUAAGCC | GGCUUAUUACUAGAGCAGA | 5750 |
| 1308 | 838 | UAUCUGUCUGCUCUAGUAA | UUACUAGAGCAGACAGAUA | 5751 |
| 1200 | 839 | GCAAGCUCAUCAUACUGGC | GCCAGUAUGAUGAGCUUGC | 5752 |
| 543 | 840 | AGAGGGUACGAGCUGCUAU | AUAGCAGCUCGUACCCUCU | 5753 |
| 1609 | 841 | UGUGCGUACUGUCCUUCGG | CCGAAGGACAGUACGCACA | 5754 |
| 1453 | 842 | GGAAGGGAUGGAAGGUCUC | GAGACCUUCCAUCCCUUCC | 5755 |
| 833 | 843 | AUGCGUUCUCCUCAGAUGG | CCAUCUGAGGAGAACGCAU | 5756 |
| 2188 | 844 | GACAGAGUUACUUCACUCU | AGAGUGAAGUAACUCUGUC | 5757 |
| 1148 | 845 | UUGGCUAUUACGACAGACU | AGUCUGUCGUAAUAGCCAA | 5758 |
| 1736 | 846 | GGACUACCAGUUGUGGUUA | UAACCACAACUGGUAGUCC | 5759 |
| 1401 | 847 | UUCAGAACUGUCUUUGGAC | GUCCAAAGACAGUUCUGAA | 5760 |
| 1677 | 848 | AUCUGACCAGCCGACACCA | UGGUGUCGGCUGGUCAGAU | 5761 |
| 1934 | 849 | ACACAGCAGCAAUUUGUGG | CCACAAAUUGCUGCUGUGU | 5762 |
| 388 | 850 | UACCACAGCUCCUUCUCUG | CAGAGAAGGAGCUGUGGUA | 5763 |
| 1920 | 851 | CGUCCAUGGGUGGGACACA | UGUGUCCCACCCAUGGACG | 5764 |
| 1747 | 852 | UGUGGUUAAGCUCUUACAC | GUGUAAGAGCUUAACCACA | 5765 |
| 861 | 853 | UUGUACGUACCAUGCAGAA | UUCUGCAUGGUACGUACAA | 5766 |
| 1904 | 854 | GAUACCCAGCGCCGUACGU | ACGUACGGCGCUGGGUAUC | 5767 |
| 831 | 855 | UCAUGCGUUCUCCUCAGAU | AUCUGAGGAGAACGCAUGA | 5768 |
| 1895 | 856 | GCACAUCAGGAUACCCAGC | GCUGGGUAUCCUGAUGUGC | 5769 |
| 2273 | 857 | GAUUACAAGAAACGGCUUU | AAAGCCGUUUCUUGUAAUC | 5770 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1738 | 858 | ACUACCAGUUGUGGUUAAG | CUUAACCACAACUGGUAGU | 5771 |
| 1395 | 859 | GUCUUGUUCAGAACUGUCU | AGACAGUUCUGAACAAGAC | 5772 |
| 1675 | 860 | UCAUCUGACCAGCCGACAC | GUGUCGGCUGGUCAGAUGA | 5773 |
| 1845 | 861 | CUUUGCGUGAGCAGGGUGC | GCACCCUGCUCACGCAAAG | 5774 |
| 1408 | 862 | CUGUCUUUGGACUCUCAGG | CCUGAGAGUCCAAAGACAG | 5775 |
| 1059 | 863 | UACAUCAAGAAGGAGCUAA | UUAGCUCCUUCUUGAUGUA | 5776 |
| 1381 | 864 | AGAUCCAAGUCAACGUCUU | AAGACGUUGACUUGGAUCU | 5777 |
| 1386 | 865 | CAAGUCAACGUCUUGUUCA | UGAACAAGACGUUGACUUG | 5778 |
| 1470 | 866 | UCCUUGGGACUCUUGUUCA | UGAACAAGAGUCCCAAGGA | 5779 |
| 1349 | 867 | GGUGGAAUGCAAGCUUUAG | CUAAAGCUUGCAUUCCACC | 5780 |
| 1440 | 868 | CUGCAACUAAACAGGAAGG | CCUUCCUGUUUAGUUGCAG | 5781 |
| 1364 | 869 | UUAGGACUUCACCUGACAG | CUGUCAGGUGAAGUCCUAA | 5782 |
| 502 | 870 | AGUAGCUGAUAUUGAUGGA | UCCAUCAAUAUCAGCUACU | 5783 |
| 1246 | 871 | UAUAAUGAGGACCUAUACU | AGUAUAGGUCCUCAUUAUA | 5784 |
| 3178 | 872 | CCUGCUGUGAUACGAUGCU | AGCAUCGUAUCACAGCAGG | 5785 |
| 2483 | 873 | AUGGGUGGCCACCACCCUG | CAGGGUGGUGGCCACCCAU | 5786 |
| 1417 | 874 | GACUCUCAGGAAUCUUUCA | UGAAAGAUUCCUGAGAGUC | 5787 |
| 1893 | 875 | GUGCACAUCAGGAUACCCA | UGGGUAUCCUGAUGUGCAC | 5788 |
| 817 | 876 | UUCCAGACACGCUAUCAUG | CAUGAUAGCGUGUCUGGAA | 5789 |
| 711 | 877 | UUGCCACACGUGCAAUCCC | GGGAUUGCACGUGUGGCAA | 5790 |
| 1433 | 878 | UCAGAUGCUGCAACUAAAC | GUUUAGUUGCAGCAUCUGA | 5791 |
| 1362 | 879 | CUUUAGGACUUCACCUGAC | GUCAGGUGAAGUCCUAAAG | 5792 |
| 1838 | 880 | CAUGCACCUUUGCGUGAGC | GCUCACGCAAAGGUGCAUG | 5793 |
| 1037 | 881 | ACAACUCUCCACAACCUUU | AAAGGUUGUGGAGAGUUGU | 5794 |
| 1474 | 882 | UGGGACUCUUGUUCAGCUU | AAGCUGAACAAGAGUCCCA | 5795 |
| 997 | 883 | GCUUGGUUCACCAGUGGAU | AUCCACUGGUGAACCAAGC | 5796 |
| 931 | 884 | UUCCCAUCAUCGUGAGGGC | GCCCUCACGAUGAUGGGAA | 5797 |
| 1313 | 885 | GUCUGCUCUAGUAAUAAGC | GCUUAUUACUAGAGCAGAC | 5798 |
| 1487 | 886 | CAGCUUCUGGGUUCAGAUG | CAUCUGAACCCAGAAGCUG | 5799 |
| 1673 | 887 | CGUCAUCUGACCAGCCGAC | GUCGGCUGGUCAGAUGACG | 5800 |
| 561 | 888 | UGUUCCUGAGACAUUAGA | UCUAAUGUCUCAGGGAACA | 5801 |
| 1188 | 889 | GCAACCAAGAAAGCAAGCU | AGCUUGCUUUCUUGGUUGC | 5802 |
| 292 | 890 | GGAGUUGGACAUGGCCAUG | CAUGGCCAUGUCCAACUCC | 5803 |
| 1958 | 891 | GUCCGCAUGGAAGAAAUAG | CUAUUUCUUCCAUGCGGAC | 5804 |
| 2349 | 892 | CUGAUCUUGGACUUGAUAU | AUAUCAAGUCCAAGAUCAG | 5805 |
| 1460 | 893 | AUGGAAGGUCUCCUUGGGA | UCCCAAGGAGACCUUCCAU | 5806 |
| 1576 | 894 | GAUGGUCUGCCAAGUGGGU | ACCCACUUGGCAGACCAUC | 5807 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 690 | 895 | ACUAUCAAGAUGAUGCAGA | UCUGCAUCAUCUUGAUAGU | 5808 |
| 655 | 896 | ACAGAUGCUGAAACAUGCA | UGCAUGUUUCAGCAUCUGU | 5809 |
| 2290 | 897 | UUCAGUUGAGCUGACCAGC | GCUGGUCAGCUCAACUGAA | 5810 |
| 1600 | 898 | AGAGGCUCUUGUGCGUACU | AGUACGCACAAGAGCCUCU | 5811 |
| 2432 | 899 | GGUGGAUAUGGCCAGGAUG | CAUCCUGGCCAUAUCCACC | 5812 |
| 710 | 900 | CUUGCCACACGUGCAAUCC | GGAUUGCACGUGUGGCAAG | 5813 |
| 1714 | 901 | GAAUGCAGUUCGCCUUCAC | GUGAAGGCGAACUGCAUUC | 5814 |
| 2005 | 902 | CCUAGCUCGGGAUGUUCAC | GUGAACAUCCCGAGCUAGG | 5815 |
| 1728 | 903 | UUCACUAUGGACUACCAGU | ACUGGUAGUCCAUAGUGAA | 5816 |
| 2482 | 904 | GAUGGGUGGCCACCACCCU | AGGGUGGUGGCCACCCAUC | 5817 |
| 768 | 905 | UGGUUAAUAAGGCUGCAGU | ACUGCAGCCUUAUUAACCA | 5818 |
| 693 | 906 | AUCAAGAUGAUGCAGAACU | AGUUCUGCAUCAUCUUGAU | 5819 |
| 3179 | 907 | CUGCUGUGAUACGAUGCUU | AAGCAUCGUAUCACAGCAG | 5820 |
| 2448 | 908 | AUGCCUUGGGUAUGGACCC | GGGUCCAUACCCAAGGCAU | 5821 |
| 3183 | 909 | UGUGAUACGAUGCUUCAAG | CUUGAAGCAUCGUAUCACA | 5822 |
| 1293 | 910 | GAGUGCUGAAGGUGCUAUC | GAUAGCACCUUCAGCACUC | 5823 |
| 544 | 911 | GAGGGUACGAGCUGCUAUG | CAUAGCAGCUCGUACCCUC | 5824 |
| 2937 | 912 | UUAAUUGUAAUCUGAAUAA | UUAUUCAGAUUACAAUUAA | 5825 |
| 1691 | 913 | CACCAAGAAGCAGAGAUGG | CCAUCUCUGCUUCUUGGUG | 5826 |
| 1353 | 914 | GAAUGCAAGCUUUAGGACU | AGUCCUAAAGCUUGCAUUC | 5827 |
| 1843 | 915 | ACCUUUGCGUGAGCAGGGU | ACCCUGCUCACGCAAAGGU | 5828 |
| 1302 | 916 | AGGUGCUAUCUGUCUGCUC | GAGCAGACAGAUAGCACCU | 5829 |
| 2130 | 917 | UUGCUCAGGACAAGGAAGC | GCUUCCUUGUCCUGAGCAA | 5830 |
| 2165 | 918 | GCUGAGGGAGCCACAGCUC | GAGCUGUGGCUCCCUCAGC | 5831 |
| 387 | 919 | CUACCACAGCUCCUUCUCU | AGAGAAGGAGCUGUGGUAG | 5832 |
| 2472 | 920 | UGGAACAUGAGAUGGGUGG | CCACCCAUCUCAUGUUCCA | 5833 |
| 857 | 921 | GCUAUUGUACGUACCAUGC | GCAUGGUACGUACAAUAGC | 5834 |
| 1816 | 922 | UCUUGCCCUUUGUCCCGCA | UGCGGGACAAAGGGCAAGA | 5835 |
| 1561 | 923 | UUAUAAGAACAAGAUGAUG | CAUCAUCUUGUUCUUAUAA | 5836 |
| 811 | 924 | GGAAGCUUCCAGACACGCU | AGCGUGUCUGGAAGCUUCC | 5837 |
| 1327 | 925 | UAAGCCGGCUAUUGUAGAA | UUCUACAAUAGCCGGCUUA | 5838 |
| 757 | 926 | GGACCAGGUGGUGGUUAAU | AUUAACCACCACCUGGUCC | 5839 |
| 507 | 927 | CUGAUAUUGAUGGACAGUA | UACUGUCCAUCAAUAUCAG | 5840 |
| 3092 | 928 | UGGGUAGGGUAAAUCAGUA | UACUGAUUUACCCUACCCA | 5841 |
| 2359 | 929 | ACUUGAUAUUGGUGCCCAG | CUGGGCACCAAUAUCAAGU | 5842 |
| 1753 | 930 | UAAGCUCUUACACCCACCA | UGGUGGGUGUAAGAGCUUA | 5843 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 273 | 931 | CUACUCAAGCUGAUUUGAU | AUCAAAUCAGCUUGAGUAG | 5844 |
| 1859 | 932 | GGUGCCAUUCCACGACUAG | CUAGUCGUGGAAUGGCACC | 5845 |
| 296 | 933 | UUGGACAUGGCCAUGGAAC | GUUCCAUGGCCAUGUCCAA | 5846 |
| 615 | 934 | CUGCUCAUCCCACUAAUGU | ACAUUAGUGGGAUGAGCAG | 5847 |
| 301 | 935 | CAUGGCCAUGGAACCAGAC | GUCUGGUUCCAUGGCCAUG | 5848 |
| 1184 | 936 | UAUGGCAACCAAGAAAGCA | UGCUUUCUUGGUUGCCAUA | 5849 |
| 1006 | 937 | ACCAGUGGAUUCUGUGUUG | CAACACAGAAUCCACUGGU | 5850 |
| 2189 | 938 | ACAGAGUUACUUCACUCUA | UAGAGUGAAGUAACUCUGU | 5851 |
| 1365 | 939 | UAGGACUUCACCUGACAGA | UCUGUCAGGUGAAGUCCUA | 5852 |
| 2442 | 940 | GCCAGGAUGCCUUGGGUAU | AUACCCAAGGCAUCCUGGC | 5853 |
| 1249 | 941 | AAUGAGGACCUAUACUUAC | GUAAGUAUAGGUCCUCAUU | 5854 |
| 1144 | 942 | AUUCUUGGCUAUUACGACA | UGUCGUAAUAGCCAAGAAU | 5855 |
| 2075 | 943 | CUUUAUUCUCCCAUUGAAA | UUUCAAUGGGAGAAUAAAG | 5856 |
| 504 | 944 | UAGCUGAUAUUGAUGGACA | UGUCCAUCAAUAUCAGCUA | 5857 |
| 1405 | 945 | GAACUGUCUUUGGACUCUC | GAGAGUCCAAAGACAGUUC | 5858 |
| 333 | 946 | UUAGUCACUGGCAGCAACA | UGUUGCUGCCAGUGACUAA | 5859 |
| 1032 | 947 | CCAUUACAACUCUCCACAA | UUGUGGAGAGUUGUAAUGG | 5860 |
| 1748 | 948 | GUGGUUAAGCUCUUACACC | GGUGUAAGAGCUUAACCAC | 5861 |
| 283 | 949 | UGAUUUGAUGGAGUUGGAC | GUCCAACUCCAUCAAAUCA | 5862 |
| 1700 | 950 | GCAGAGAUGGCCCAGAAUG | CAUUCUGGGCCAUCUCUGC | 5863 |
| 1445 | 951 | ACUAAACAGGAAGGGAUGG | CCAUCCCUUCCUGUUUAGU | 5864 |
| 1133 | 952 | ACAAAUGUUAAAUUCUUGG | CCAAGAAUUUAACAUUUGU | 5865 |
| 527 | 953 | GCAAUGACUCGAGCUCAGA | UCUGAGCUCGAGUCAUUGC | 5866 |
| 2010 | 954 | CUCGGGAUGUUCACAACCG | CGGUUGUGAACAUCCCGAG | 5867 |
| 851 | 955 | GUGUCUGCUAUUGUACGUA | UACGUACAAUAGCAGACAC | 5868 |
| 436 | 956 | UGUGGAUACCUCCCAAGUC | GACUUGGGAGGUAUCCACA | 5869 |
| 2446 | 957 | GGAUGCCUUGGGUAUGGAC | GUCCAUACCCAAGGCAUCC | 5870 |
| 1142 | 958 | AAAUUCUUGGCUAUUACGA | UCGUAAUAGCCAAGAAUUU | 5871 |
| 549 | 959 | UACGAGCUGCUAUGUUCCC | GGGAACAUAGCAGCUCGUA | 5872 |
| 1083 | 960 | CAGUGCGUUUAGCUGGUGG | CCACCAGCUAAACGCACUG | 5873 |
| 695 | 961 | CAAGAUGAUGCAGAACUUG | CAAGUUCUGCAUCAUCUUG | 5874 |
| 885 | 962 | AUGAUGUAGAAACAGCUCG | CGAGCUGUUUCUACAUCAU | 5875 |
| 2067 | 963 | UGCAGCUGCUUUAUUCUCC | GGAGAAUAAAGCAGCUGCA | 5876 |
| 390 | 964 | CCACAGCUCCUUCUCUGAG | CUCAGAGAAGGAGCUGUGG | 5877 |
| 1719 | 965 | CAGUUCGCCUUCACUAUGG | CCAUAGUGAAGGCGAACUG | 5878 |
| 813 | 966 | AAGCUUCCAGACACGCUAU | AUAGCGUGUCUGGAAGCUU | 5879 |
| 2289 | 967 | UUUCAGUUGAGCUGACCAG | CUGGUCAGCUCAACUGAAA | 5880 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 377 | 968 | UCUGGUGCCACUACCACAG | CUGUGGUAGUGGCACCAGA | 5881 |
| 826 | 969 | CGCUAUCAUGCGUUCUCCU | AGGAGAACGCAUGAUAGCG | 5882 |
| 1634 | 970 | GACAGGGAAGACAUCACUG | CAGUGAUGUCUUCCCUGUC | 5883 |
| 1208 | 971 | AUCAUACUGGCUAGUGGUG | CACCACUAGCCAGUAUGAU | 5884 |
| 1628 | 972 | GCUGGUGACAGGGAAGACA | UGUCUUCCCUGUCACCAGC | 5885 |
| 2003 | 973 | AUCCUAGCUCGGGAUGUUC | GAACAUCCCGAGCUAGGAU | 5886 |
| 452 | 974 | GUCCUGUAUGAGUGGGAAC | GUUCCCACUCAUACAGGAC | 5887 |
| 3081 | 975 | UGGGAUAUGUAUGGGUAGG | CCUACCCAUACAUAUCCCA | 5888 |
| 2354 | 976 | CUUGGACUUGAUAUUGGUG | CACCAAUAUCAAGUCCAAG | 5889 |
| 1822 | 977 | CCUUUGUCCCGCAAAUCAU | AUGAUUUGCGGGACAAAGG | 5890 |
| 1299 | 978 | UGAAGGUGCUAUCUGUCUG | CAGACAGAUAGCACCUUCA | 5891 |
| 486 | 979 | CCUUCACUCAAGAACAAGU | ACUUGUUCUUGAGUGAAGG | 5892 |
| 1463 | 980 | GAAGGUCUCCUUGGGACUC | GAGUCCCAAGGAGACCUUC | 5893 |
| 2280 | 981 | AGAAACGGCUUUCAGUUGA | UCAACUGAAAGCCGUUUCU | 5894 |
| 1907 | 982 | ACCCAGCGCCGUACGUCCA | UGGACGUACGGCGCUGGGU | 5895 |
| 923 | 983 | CAUAACCUUUCCCAUCAUC | GAUGAUGGGAAAGGUUAUG | 5896 |
| 1979 | 984 | GAAGGUUGUACCGGAGCCC | GGGCUCCGGUACAACCUUC | 5897 |
| 1827 | 985 | GUCCCGCAAAUCAUGCACC | GGUGCAUGAUUUGCGGGAC | 5898 |
| 1201 | 986 | CAAGCUCAUCAUACUGGCU | AGCCAGUAUGAUGAGCUUG | 5899 |
| 1913 | 987 | CGCCGUACGUCCAUGGGUG | CACCCAUGGACGUACGGCG | 5900 |
| 2191 | 988 | AGAGUUACUUCACUCUAGG | CCUAGAGUGAAGUAACUCU | 5901 |
| 295 | 989 | GUUGGACAUGGCCAUGGAA | UUCCAUGGCCAUGUCCAAC | 5902 |
| 1149 | 990 | UGGCUAUUACGACAGACUG | CAGUCUGUCGUAAUAGCCA | 5903 |
| 533 | 991 | ACUCGAGCUCAGAGGGUAC | GUACCCUCUGAGCUCGAGU | 5904 |
| 604 | 992 | ACAGUUUGAUGCUGCUCAU | AUGAGCAGCAUCAAACUGU | 5905 |
| 766 | 993 | GGUGGUUAAUAAGGCUGCA | UGCAGCCUUAUUAACCACC | 5906 |
| 1823 | 994 | CUUUGUCCCGCAAAUCAUG | CAUGAUUUGCGGGACAAAG | 5907 |
| 2048 | 995 | AAUACCAUUCCAUUGUUUG | CAAACAAUGGAAUGGUAUU | 5908 |
| 714 | 996 | CCACACGUGCAAUCCCUGA | UCAGGGAUUGCACGUGUGG | 5909 |
| 2439 | 997 | AUGGCCAGGAUGCCUUGGG | CCCAAGGCAUCCUGGCCAU | 5910 |
| 1903 | 998 | GGAUACCCAGCGCCGUACG | CGUACGGCGCUGGGUAUCC | 5911 |
| 2395 | 999 | UCGCCAGGAUGAUCCUAGC | GCUAGGAUCAUCCUGGCGA | 5912 |
| 789 | 1000 | UGGUCCAUCAGCUUUCUAA | UUAGAAAGCUGAUGGACCA | 5913 |
| 3085 | 1001 | AUAUGUAUGGGUAGGGUAA | UUACCCUACCCAUACAUAU | 5914 |
| 1710 | 1002 | CCCAGAAUGCAGUUCGCCU | AGGCGAACUGCAUUCUGGG | 5915 |
| 1336 | 1003 | UAUUGUAGAAGCUGGUGGA | UCCACCAGCUUCUACAAUA | 5916 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 3089 | 1004 | GUAUGGGUAGGGUAAAUCA | UGAUUUACCCUACCCAUAC | 5917 |
| 2351 | 1005 | GAUCUUGGACUUGAUAUUG | CAAUAUCAAGUCCAAGUAC | 5918 |
| 716 | 1006 | ACACGUGCAAUCCCUGAAC | GUUCAGGGAUUGCACGUGU | 5919 |
| 1911 | 1007 | AGCGCCGUACGUCCAUGGG | CCCAUGGACGUACGGCGCU | 5920 |
| 1985 | 1008 | UGUACCGGAGCCCUUCACA | UGUGAAGGGCUCCGGUACA | 5921 |
| 2516 | 1009 | GUUGAUGGGCUGCCAGAUC | GAUCUGGCAGCCCAUCAAC | 5922 |
| 1762 | 1010 | ACACCCACCAUCCCACUGG | CCAGUGGGAUGGUGGGUGU | 5923 |
| 1156 | 1011 | UACGACAGACUGCCUUCAA | UUGAAGGCAGUCUGUCGUA | 5924 |
| 1887 | 1012 | UUGUUCGUGCACAUCAGGA | UCCUGAUGUGCACGAACAA | 5925 |
| 1833 | 1013 | CAAAUCAUGCACCUUUGCG | CGCAAAGGUGCAUGAUUUG | 5926 |
| 967 | 1014 | GUCUGGAGGCAUUCCUGCC | GGCAGGAAUGCCUCCAGAC | 5927 |
| 1730 | 1015 | CACUAUGGACUACCAGUUG | CAACUGGUAGUCCAUAGUG | 5928 |
| 829 | 1016 | UAUCAUGCGUUCUCCUCAG | CUGAGGAGAACGCAUGAUA | 5929 |
| 890 | 1017 | GUAGAAACAGCUCGUUGUA | UACAACGAGCUGUUUCUAC | 5930 |
| 2181 | 1018 | CUCCUCUGACAGAGUUACU | AGUAACUCUGUCAGAGGAG | 5931 |
| 2131 | 1019 | UGCUCAGGACAAGGAAGCU | AGCUUCCUUGUCCUGAGCA | 5932 |
| 1586 | 1020 | CAAGUGGGUGGUAUAGAGG | CCUCUAUACCACCCACUUG | 5933 |
| 765 | 1021 | UGGUGGUUAAUAAGGCUGC | GCAGCCUUAUUAACCACCA | 5934 |
| 1369 | 1022 | ACUUCACCUGACAGAUCCA | UGGAUCUGUCAGGUGAAGU | 5935 |
| 1724 | 1023 | CGCCUUCACUAUGGACUAC | GUAGUCCAUAGUGAAGGCG | 5936 |
| 834 | 1024 | UGCGUUCUCCUCAGAUGGU | ACCAUCUGAGGAGAACGCA | 5937 |
| 1983 | 1025 | GUUGUACCGGAGCCCUUCA | UGAAGGGCUCCGGUACAAC | 5938 |
| 1688 | 1026 | CGACACCAAGAAGCAGAGA | UCUCUGCUUCUUGGUGUCG | 5939 |
| 1004 | 1027 | UCACCAGUGGAUUCUGUGU | ACACAGAAUCCACUGGUGA | 5940 |
| 1631 | 1028 | GGUGACAGGGAAGACAUCA | UGAUGUCUUCCCUGUCACC | 5941 |
| 1319 | 1029 | UCUAGUAAUAAGCCGGCUA | UAGCCGGCUUAUUACUAGA | 5942 |
| 767 | 1030 | GUGGUUAAUAAGGCUGCAG | CUGCAGCCUUAUUAACCAC | 5943 |
| 841 | 1031 | UCCUCAGAUGGUGUCUGCU | AGCAGACACCAUCUGAGGA | 5944 |
| 516 | 1032 | AUGGACAGUAUGCAAUGAC | GUCAUUGCAUACUGUCCAU | 5945 |
| 1848 | 1033 | UGCGUGAGCAGGGUGCCAU | AUGGCACCCUGCUCACGCA | 5946 |
| 2202 | 1034 | ACUCUAGGAAUGAAGGUGU | ACACCUUCAUUCCUAGAGU | 5947 |
| 571 | 1035 | GACAUUAGAUGAGGGCAUG | CAUGCCCUCAUCUAAUGUC | 5948 |
| 1629 | 1036 | CUGGUGACAGGGAAGACAU | AUGUCUUCCCUGUCACCAG | 5949 |
| 1806 | 1037 | UGAUUCGAAAUCUUGCCCU | AGGGCAAGAUUUCGAAUCA | 5950 |
| 1756 | 1038 | GCUCUUACACCCACCAUCC | GGAUGGUGGGUGUAAGAGC | 5951 |
| 1619 | 1039 | GUCCUUCGGGCUGGUGACA | UGUCACCAGCCCGAAGGAC | 5952 |
| 1610 | 1040 | GUGCGUACUGUCCUUCGGG | CCCGAAGGACAGUACGCAC | 5953 |

TABLE 1b-continued

Various c-CTNNB1 siNA sense and antisense sequences corresponding
to the identified target sequences in Table 1a.

| Target Site (human) | SEQ ID NO: | Sense Sequence | Antisense Sequence | SEQ ID NO: |
|---|---|---|---|---|
| 2500 | 1041 | UGGUGCUGACUAUCCAGUU | AACUGGAUAGUCAGCACCA | 5954 |
| 2156 | 1042 | GCUAUUGAAGCUGAGGGAG | CUCCCUCAGCUUCAAUAGC | 5955 |
| 1189 | 1043 | CAACCAAGAAAGCAAGCUC | GAGCUUGCUUUCUUGGUUG | 5956 |
| 2066 | 1044 | GUGCAGCUGCUUUAUUCUC | GAGAAUAAAGCAGCUGCAC | 5957 |
| 1307 | 1045 | CUAUCUGUCUGCUCUAGUA | UACUAGAGCAGACAGAUAG | 5958 |
| 1448 | 1046 | AAACAGGAAGGGAUGGAAG | CUUCCAUCCCUUCCUGUUU | 5959 |
| 1213 | 1047 | ACUGGCUAGUGGUGGACCC | GGGUCCACCACUAGCCAGU | 5960 |
| 2119 | 1048 | CCUCUGUGAACUUGCUCAG | CUGAGCAAGUUCACAGAGG | 5961 |
| 889 | 1049 | UGUAGAAACAGCUCGUUGU | ACAACGAGCUGUUUCUACA | 5962 |
| 1376 | 1050 | CUGACAGAUCCAAGUCAAC | GUUGACUUGGAUCUGUCAG | 5963 |
| 427 | 1051 | GGAAGAGGAUGUGGAUACC | GGUAUCCACAUCCUCUUCC | 5964 |
| 649 | 1052 | ACCAUCACAGAUGCUGAAA | UUUCAGCAUCUGUGAUGGU | 5965 |
| 1915 | 1053 | CCGUACGUCCAUGGGUGGG | CCCACCCAUGGACGUACGG | 5966 |
| 2053 | 1054 | CAUUCCAUUGUUUGUGCAG | CUGCACAAACAAUGGAAUG | 5967 |
| 2568 | 1055 | CUCCAGGUGACAGCAAUCA | UGAUUGCUGUCACCUGGAG | 5968 |
| 1739 | 1056 | CUACCAGUUGUGGUUAAGC | GCUUAACCACAACUGGUAG | 5969 |
| 1746 | 1057 | UUGUGGUUAAGCUCUUACA | UGUAAGAGCUUAACCACAA | 5970 |
| 1321 | 1058 | UAGUAAUAAGCCGGCUAUU | AAUAGCCGGCUUAUUACUA | 5971 |
| 482 | 1059 | CAGUCCUUCACUCAAGAAC | GUUCUUGAGUGAAGGACUG | 5972 |
| 280 | 1060 | AGCUGAUUUGAUGGAGUUG | CAACUCCAUCAAAUCAGCU | 5973 |
| 1465 | 1061 | AGGUCUCCUUGGGACUCUU | AAGAGUCCCAAGGAGACCU | 5974 |
| 1731 | 1062 | ACUAUGGACUACCAGUUGU | ACAACUGGUAGUCCAUAGU | 5975 |
| 1937 | 1063 | CAGCAGCAAUUUGUGGAGG | CCUCCACAAAUUGCUGCUG | 5976 |
| 1892 | 1064 | CGUGCACAUCAGGAUACCC | GGGUAUCCUGAUGUGCACG | 5977 |
| 836 | 1065 | CGUUCUCCUCAGAUGGUGU | ACACCAUCUGAGGAGAACG | 5978 |
| 521 | 1066 | CAGUAUGCAAUGACUCGAG | CUCGAGUCAUUGCAUACUG | 5979 |
| 1595 | 1067 | GGUAUAGAGGCUCUUGUGC | GCACAAGAGCCUCUAUACC | 5980 |
| 2511 | 1068 | AUCCAGUUGAUGGGCUGCC | GGCAGCCCAUCAACUGGAU | 5981 |
| 1583 | 1069 | UGCCAAGUGGGUGGUAUAG | CUAUACCACCCACUUGGCA | 5982 |
| 1897 | 1070 | ACAUCAGGAUACCCAGCGC | GCGCUGGGUAUCCUGAUGU | 5983 |
| 956 | 1071 | GCCAUCUUUAAGUCUGGAG | CUCCAGACUUAAAGAUGGC | 5984 |
| 926 | 1072 | AACCUUUCCCAUCAUCGUG | CACGAUGAUGGGAAAGGUU | 5985 |
| 1874 | 1073 | CUAGUUCAGUUGCUUGUUC | GAACAAGCAACUGAACUAG | 5986 |
| 488 | 1074 | UUCACUCAAGAACAAGUAG | CUACUUGUUCUUGAGUGAA | 5987 |
| 1695 | 1075 | AAGAAGCAGAGAUGGCCCA | UGGGCCAUCUCUGCUUCUU | 5988 |
| 2182 | 1076 | UCCUCUGACAGAGUUACUU | AAGUAACUCUGUCAGAGGA | 5989 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 2029 | 1077 | AAUUGUUAUCAGAGGACUA | UAGUCCUCUGAUAACAAUU | 5990 |
| 479 | 1078 | UCUCAGUCCUUCACUCAAG | CUUGAGUGAAGGACUGAGA | 5991 |
| 818 | 1079 | UCCAGACACGCUAUCAUGC | GCAUGAUAGCGUGUCUGGA | 5992 |
| 625 | 1080 | CACUAAUGUCCAGCGUUUG | CAAACGCUGGACAUUAGUG | 5993 |
| 3172 | 1081 | UUGUAACCUGCUGUGAUAC | GUAUCACAGCAGGUUACAA | 5994 |
| 1490 | 1082 | CUUCUGGGUUCAGAUGAUA | UAUCAUCUGAACCCAGAAG | 5995 |
| 1914 | 1083 | GCCGUACGUCCAUGGGUGG | CCACCCAUGGACGUACGGC | 5996 |
| 1974 | 1084 | UAGUUGAAGGUUGUACCGG | CCGGUACAACCUUCAACUA | 5997 |
| 2258 | 1085 | GAGGACAAGCCACAAGAUU | AAUCUUGUGGCUUGUCCUC | 5998 |
| 2170 | 1086 | GGGAGCCACAGCUCCUCUG | CAGAGGAGCUGUGGCUCCC | 5999 |
| 1370 | 1087 | CUUCACCUGACAGAUCCAA | UUGGAUCUGUCAGGUGAAG | 6000 |
| 1429 | 1088 | UCUUUCAGAUGCUGCAACU | AGUUGCAGCAUCUGAAAGA | 6001 |
| 3173 | 1089 | UGUAACCUGCUGUGAUACG | CGUAUCACAGCAGGUUACA | 6002 |
| 444 | 1090 | CCUCCCAAGUCCUGUAUGA | UCAUACAGGACUUGGGAGG | 6003 |
| 1081 | 1091 | GGCAGUGCGUUUAGCUGGU | ACCAGCUAAACGCACUGCC | 6004 |
| 1318 | 1092 | CUCUAGUAAUAAGCCGGCU | AGCCGGCUUAUUACUAGAG | 6005 |
| 329 | 1093 | GCUGUUAGUCACUGGCAGC | GCUGCCAGUGACUAACAGC | 6006 |
| 1389 | 1094 | GUCAACGUCUUGUUCAGAA | UUCUGAACAAGACGUUGAC | 6007 |
| 428 | 1095 | GAAGAGGAUGUGGAUACCU | AGGUAUCCACAUCCUCUUC | 6008 |
| 3175 | 1096 | UAACCUGCUGUGAUACGAU | AUCGUAUCACAGCAGGUUA | 6009 |
| 3117 | 1097 | GUUAUUUGGAACCUUGUUU | AAACAAGGUUCCAAAUAAC | 6010 |
| 2020 | 1098 | UCACAACCGAAUUGUUAUC | GAUAACAAUUCGGUUGUGA | 6011 |
| 1625 | 1099 | CGGGCUGGUGACAGGGAAG | CUUCCCUGUCACCAGCCCG | 6012 |
| 2022 | 1100 | ACAACCGAAUUGUUAUCAG | CUGAUAACAAUUCGGUUGU | 6013 |
| 624 | 1101 | CCACUAAUGUCCAGCGUUU | AAACGCUGGACAUUAGUGG | 6014 |
| 1648 | 1102 | CACUGAGCCUGCCAUCUGU | ACAGAUGGCAGGCUCAGUG | 6015 |
| 790 | 1103 | GGUCCAUCAGCUUUCUAAA | UUUAGAAAGCUGAUGGACC | 6016 |
| 3160 | 1104 | AUCCCAAAGUUGUUGUAAC | GUUACAACAACUUUGGGAU | 6017 |
| 1251 | 1105 | UGAGGACCUAUACUUACGA | UCGUAAGUAUAGGUCCUCA | 6018 |
| 2253 | 1106 | UGUCUGAGGACAAGCCACA | UGUGGCUUGUCCUCAGACA | 6019 |
| 2515 | 1107 | AGUUGAUGGGCUGCCAGAU | AUCUGGCAGCCCAUCAACU | 6020 |
| 1680 | 1108 | UGACCAGCCGACACCAAGA | UCUUGGUGUCGGCUGGUCA | 6021 |
| 2169 | 1109 | AGGGAGCCACAGCUCCUCU | AGAGGAGCUGUGGCUCCCU | 6022 |
| 3165 | 1110 | AAAGUUGUUGUAACCUGCU | AGCAGGUUACAACAACUUU | 6023 |
| 780 | 1111 | CUGCAGUUAUGGUCCAUCA | UGAUGGACCAUAACUGCAG | 6024 |
| 1978 | 1112 | UGAAGGUUGUACCGGAGCC | GGCUCCGGUACAACCUUCA | 6025 |
| 563 | 1113 | UUCCCUGAGACAUUAGAUG | CAUCUAAUGUCUCAGGGAA | 6026 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1622 | 1114 | CUUCGGGCUGGUGACAGGG | CCCUGUCACCAGCCCGAAG | 6027 |
| 2295 | 1115 | UUGAGCUGACCAGCUCUCU | AGAGAGCUGGUCAGCUCAA | 6028 |
| 2126 | 1116 | GAACUUGCUCAGGACAAGG | CCUUGUCCUGAGCAAGUUC | 6029 |
| 1683 | 1117 | CCAGCCGACACCAAGAAGC | GCUUCUUGGUGUCGGCUGG | 6030 |
| 1857 | 1118 | AGGGUGCCAUUCCACGACU | AGUCGUGGAAUGGCACCCU | 6031 |
| 2064 | 1119 | UUGUGCAGCUGCUUUAUUC | GAAUAAAGCAGCUGCACAA | 6032 |
| 489 | 1120 | UCACUCAAGAACAAGUAGC | GCUACUUGUUCUUGAGUGA | 6033 |
| 1346 | 1121 | GCUGGUGGAAUGCAAGCUU | AAGCUUGCAUUCCACCAGC | 6034 |
| 1442 | 1122 | GCAACUAAACAGGAAGGGA | UCCCUUCCUGUUUAGUUGC | 6035 |
| 1981 | 1123 | AGGUUGUACCGGAGCCCUU | AAGGGCUCCGGUACAACCU | 6036 |
| 777 | 1124 | AGGCUGCAGUUAUGGUCCA | UGGACCAUAACUGCAGCCU | 6037 |
| 589 | 1125 | GCAGAUCCCAUCUACACAG | CUGUGUAGAUGGGAUCUGC | 6038 |
| 2205 | 1126 | CUAGGAAUGAAGGUGUGGC | GCCACACCUUCAUUCCUAG | 6039 |
| 394 | 1127 | AGCUCCUUCUCUGAGUGGU | ACCACUCAGAGAAGGAGCU | 6040 |
| 1035 | 1128 | UUACAACUCUCCACAACCU | AGGUUGUGGAGAGUUGUAA | 6041 |
| 410 | 1129 | GGUAAAGGCAAUCCUGAGG | CCUCAGGAUUGCCUUUACC | 6042 |
| 1721 | 1130 | GUUCGCCUUCACUAUGGAC | GUCCAUAGUGAAGGCGAAC | 6043 |
| 1134 | 1131 | CAAAUGUUAAAUUCUUGGC | GCCAAGAAUUUAACAUUUG | 6044 |
| 3182 | 1132 | CUGUGAUACGAUGCUUCAA | UUGAAGCAUCGUAUCACAG | 6045 |
| 881 | 1133 | ACAAAUGAUGUAGAAACAG | CUGUUUCUACAUCAUUUGU | 6046 |
| 547 | 1134 | GGUACGAGCUGCUAUGUUC | GAACAUAGCAGCUCGUACC | 6047 |
| 2028 | 1135 | GAAUUGUUAUCAGAGGACU | AGUCCUCUGAUAACAAUUC | 6048 |
| 2023 | 1136 | CAACCGAAUUGUUAUCAGA | UCUGAUAACAAUUCGGUUG | 6049 |
| 3184 | 1137 | GUGAUACGAUGCUUCAAGA | UCUUGAAGCAUCGUAUCAC | 6050 |
| 413 | 1138 | AAGGCAAUCCUGAGGAAG | CUUCCUCAGGAUUGCCUUU | 6051 |
| 2178 | 1139 | CAGCUCCUCUGACAGAGUU | AACUCUGUCAGAGGAGCUG | 6052 |
| 1577 | 1140 | AUGGUCUGCCAAGUGGGUG | CACCCACUUGGCAGACCAU | 6053 |
| 1793 | 1141 | GCUACUGUUGGAUUGAUUC | GAAUCAAUCCAACAGUAGC | 6054 |
| 526 | 1142 | UGCAAUGACUCGAGCUCAG | CUGAGCUCGAGUCAUUGCA | 6055 |
| 2358 | 1143 | GACUUGAUAUUGGUGCCCA | UGGGCACCAAUAUCAAGUC | 6056 |
| 1403 | 1144 | CAGAACUGUCUUUGGACUC | GAGUCCAAAGACAGUUCUG | 6057 |
| 1875 | 1145 | UAGUUCAGUUGCUUGUUCG | CGAACAAGCAACUGAACUA | 6058 |
| 1160 | 1146 | ACAGACUGCCUUCAAAUUU | AAAUUUGAAGGCAGUCUGU | 6059 |
| 1591 | 1147 | GGGUGGUAUAGAGGCUCUU | AAGAGCCUCUAUACCACCC | 6060 |
| 1734 | 1148 | AUGGACUACCAGUUGUGGU | ACCACAACUGGUAGUCCAU | 6061 |
| 2030 | 1149 | AUUGUUAUCAGAGGACUAA | UUAGUCCUCUGAUAACAAU | 6062 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 775 | 1150 | UAAGGCUGCAGUUAUGGUC | GACCAUAACUGCAGCCUUA | 6063 |
| 1813 | 1151 | AAAUCUUGCCCUUUGUCCC | GGGACAAAGGGCAAGAUUU | 6064 |
| 1938 | 1152 | AGCAGCAAUUUGUGGAGGG | CCCUCCACAAAUUGCUGCU | 6065 |
| 2039 | 1153 | AGAGGACUAAAUACCAUUC | GAAUGGUAUUUAGUCCUCU | 6066 |
| 1297 | 1154 | GCUGAAGGUGCUAUCUGUC | GACAGAUAGCACCUUCAGC | 6067 |
| 456 | 1155 | UGUAUGAGUGGGAACAGGG | CCCUGUUCCCACUCAUACA | 6068 |
| 590 | 1156 | CAGAUCCCAUCUACACAGU | ACUGUGUAGAUGGGAUCUG | 6069 |
| 1933 | 1157 | GACACAGCAGCAAUUUGUG | CACAAAUUGCUGCUGUGUC | 6070 |
| 583 | 1158 | GGGCAUGCAGAUCCCAUCU | AGAUGGGAUCUGCAUGCCC | 6071 |
| 2540 | 1159 | CAUGCCCAGGACCUCAUGG | CCAUGAGGUCCUGGGCAUG | 6072 |
| 2162 | 1160 | GAAGCUGAGGGAGCCACAG | CUGUGGCUCCCUCAGCUUC | 6073 |
| 330 | 1161 | CUGUUAGUCACUGGCAGCA | UGCUGCCAGUGACUAACAG | 6074 |
| 1481 | 1162 | CUUGUUCAGCUUCUGGGUU | AACCCAGAAGCUGAACAAG | 6075 |
| 1344 | 1163 | AAGCUGGUGGAAUGCAAGC | GCUUGCAUUCCACCAGCUU | 6076 |
| 431 | 1164 | GAGGAUGUGGAUACCUCCC | GGGAGGUAUCCACAUCCUC | 6077 |
| 1508 | 1165 | AUAAAUGUGGUCACCUGUG | CACAGGUGACCACAUUUAU | 6078 |
| 1918 | 1166 | UACGUCCAUGGGUGGGACA | UGUCCACCCAUGGACGUA | 6079 |
| 289 | 1167 | GAUGGAGUUGGACAUGGCC | GGCCAUGUCCAACUCCAUC | 6080 |
| 631 | 1168 | UGUCCAGCGUUUGGCUGAA | UUCAGCCAAACGCUGGACA | 6081 |
| 1853 | 1169 | GAGCAGGGUGCCAUUCCAC | GUGGAAUGGCACCCUGCUC | 6082 |
| 1243 | 1170 | AAAUAUAAUGAGGACCAU | AUAGGUCCUCAUUAUAUUU | 6083 |
| 1212 | 1171 | UACUGGCUAGUGGUGGACC | GGUCCACCACUAGCCAGUA | 6084 |
| 996 | 1172 | UGCUUGGUUCACCAGUGGA | UCCACUGGUGAACCAAGCA | 6085 |
| 2256 | 1173 | CUGAGGACAAGCCACAAGA | UCUUGUGGCUUGUCCUCAG | 6086 |
| 1607 | 1174 | CUUGUGCGUACUGUCCUUC | GAAGGACAGUACGCACAAG | 6087 |
| 3116 | 1175 | UGUUAUUUGGAACCUUGUU | AACAAGGUUCCAAAUAACA | 6088 |
| 1179 | 1176 | UAGCUUAUGGCAACCAAGA | UCUUGGUUGCCAUAAGCUA | 6089 |
| 3185 | 1177 | UGAUACGAUGCUUCAAGAG | CUCUUGAAGCAUCGUAUCA | 6090 |
| 1594 | 1178 | UGGUAUAGAGGCUCUUGUG | CACAAGAGCCUCUAUACCA | 6091 |
| 887 | 1179 | GAUGUAGAAACAGCUCGUU | AACGAGCUGUUUCUACAUC | 6092 |
| 928 | 1180 | CCUUUCCCAUCAUCGUGAG | CUCACGAUGAUGGGAAAGG | 6093 |
| 835 | 1181 | GCGUUCUCCUCAGAUGGUG | CACCAUCUGAGGAGAACGC | 6094 |
| 1900 | 1182 | UCAGGAUACCCAGCGCCGU | ACGGCGCUGGGUAUCCUGA | 6095 |
| 2284 | 1183 | ACGGCUUUCAGUUGAGCUG | CAGCUCAACUGAAAGCCGU | 6096 |
| 1976 | 1184 | GUUGAAGGUUGUACCGGAG | CUCCGGUACAACCUUCAAC | 6097 |
| 2393 | 1185 | UAUCGCCAGGAUGAUCCUA | UAGGAUCAUCCUGGCGAUA | 6098 |
| 1295 | 1186 | GUGCUGAAGGUGCUAUCUG | CAGAUAGCACCUUCAGCAC | 6099 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1410 | 1187 | GUCUUUGGACUCUCAGGAA | UUCCUGAGAGUCCAAAGAC | 6100 |
| 1457 | 1188 | GGGAUGGAAGGUCUCCUUG | CAAGGAGACCUUCCAUCCC | 6101 |
| 2296 | 1189 | UGAGCUGACCAGCUCUCUC | GAGAGAGCUGGUCAGCUCA | 6102 |
| 929 | 1190 | CUUUCCCAUCAUCGUGAGG | CCUCACGAUGAUGGGAAAG | 6103 |
| 1359 | 1191 | AAGCUUUAGGACUUCACCU | AGGUGAAGUCCUAAAGCUU | 6104 |
| 1351 | 1192 | UGGAAUGCAAGCUUUAGGA | UCCUAAAGCUUGCAUUCCA | 6105 |
| 969 | 1193 | CUGGAGGCAUUCCUGCCCU | AGGGCAGGAAUGCCUCCAG | 6106 |
| 1876 | 1194 | AGUUCAGUUGCUUGUUCGU | ACGAACAAGCAACUGAACU | 6107 |
| 552 | 1195 | GAGCUGCUAUGUUCCCUGA | UCAGGGAACAUAGCAGCUC | 6108 |
| 2441 | 1196 | GGCCAGGAUGCCUUGGGUA | UACCCAAGGCAUCCUGGCC | 6109 |
| 2402 | 1197 | GAUGAUCCUAGCUAUCGUU | AACGAUAGCUAGGAUCAUC | 6110 |
| 1803 | 1198 | GAUUGAUUCGAAAUCUUGC | GCAAGAUUUCGAAUCAAUC | 6111 |
| 1701 | 1199 | CAGAGAUGGCCCAGAAUGC | GCAUUCUGGGCCAUCUCUG | 6112 |
| 1910 | 1200 | CAGCGCCGUACGUCCAUGG | CCAUGGACGUACGGCGCUG | 6113 |
| 888 | 1201 | AUGUAGAAACAGCUCGUUG | CAACGAGCUGUUUCUACAU | 6114 |
| 1294 | 1202 | AGUGCUGAAGGUGCUAUCU | AGAUAGCACCUUCAGCACU | 6115 |
| 1737 | 1203 | GACUACCAGUUGUGGUUAA | UUAACCACAACUGGUAGUC | 6116 |
| 1450 | 1204 | ACAGGAAGGGAUGGAAGGU | ACCUUCCAUCCCUUCCUGU | 6117 |
| 761 | 1205 | CAGGUGGUGGUUAAUAAGG | CCUUAUUAACCACCACCUG | 6118 |
| 776 | 1206 | AAGGCUGCAGUUAUGGUCC | GGACCAUAACUGCAGCCUU | 6119 |
| 1509 | 1207 | UAAAUGUGGUCACCUGUGC | GCACAGGUGACCACAUUUA | 6120 |
| 1788 | 1208 | UAAAGGCUACUGUUGGAUU | AAUCCAACAGUAGCCUUUA | 6121 |
| 515 | 1209 | GAUGGACAGUAUGCAAUGA | UCAUUGCAUACUGUCCAUC | 6122 |
| 1491 | 1210 | UUCGGGUUCAGAUGAUAU | AUAUCAUCUGAACCCAGAA | 6123 |
| 1614 | 1211 | GUACUGUCCUUCGGGCUGG | CCAGCCCGAAGGACAGUAC | 6124 |
| 998 | 1212 | CUUGGUUCACCAGUGGAUU | AAUCCACUGGUGAACCAAG | 6125 |
| 2158 | 1213 | UAUUGAAGCUGAGGGAGCC | GGCUCCCUCAGCUUCAAUA | 6126 |
| 3168 | 1214 | GUUGUUGUAACCUGCUGUG | CACAGCAGGUUACAACAAC | 6127 |
| 1854 | 1215 | AGCAGGGUGCCAUUCCACG | CGUGGAAUGGCACCCUGCU | 6128 |
| 2117 | 1216 | GUCCUCUGUGAACUUGCUC | GAGCAAGUUCACAGAGGAC | 6129 |
| 1678 | 1217 | UCUGACCAGCCGACACCAA | UUGGUGUCGGCUGGUCAGA | 6130 |
| 305 | 1218 | GCCAUGGAACCAGACAGAA | UUCUGUCUGGUUCCAUGGC | 6131 |
| 2154 | 1219 | AAGCUAUUGAAGCUGAGGG | CCCUCAGCUUCAAUAGCUU | 6132 |
| 1807 | 1220 | GAUUCGAAAUCUUGCCCUU | AAGGGCAAGAUUUCGAAUC | 6133 |
| 1881 | 1221 | AGUUGCUUGUUCGUGCACA | UGUGCACGAACAAGCAACU | 6134 |
| 1565 | 1222 | AAGAACAAGAUGAUGGUCU | AGACCAUCAUCUUGUUCUU | 6135 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 407 | 1223 | AGUGGUAAAGGCAAUCCUG | CAGGAUUGCCUUUACCACU | 6136 |
| 1434 | 1224 | CAGAUGCUGCAACUAAACA | UGUUUAGUUGCAGCAUCUG | 6137 |
| 566 | 1225 | CCUGAGACAUUAGAUGAGG | CCUCAUCUAAUGUCUCAGG | 6138 |
| 3161 | 1226 | UCCCAAAGUUGUUGUAACC | GGUUACAACAACUUUGGGA | 6139 |
| 1679 | 1227 | CUGACCAGCCGACACCAAG | CUUGGUGUCGGCUGGUCAG | 6140 |
| 2096 | 1228 | AUCCAAAGAGUAGCUGCAG | CUGCAGCUACUCUUUGGAU | 6141 |
| 630 | 1229 | AUGUCCAGCGUUUGGCUGA | UCAGCCAAACGCUGGACAU | 6142 |
| 1606 | 1230 | UCUUGUGCGUACUGUCCUU | AAGGACAGUACGCACAAGA | 6143 |
| 432 | 1231 | AGGAUGUGGAUACCUCCCA | UGGGAGGUAUCCACAUCCU | 6144 |
| 778 | 1232 | GGCUGCAGUUAUGGUCCAU | AUGGACCAUAACUGCAGCC | 6145 |
| 1999 | 1233 | UCACAUCCUAGCUCGGGAU | AUCCCGAGCUAGGAUGUGA | 6146 |
| 1692 | 1234 | ACCAAGAAGCAGAGAUGGC | GCCAUCUCUGCUUCUUGGU | 6147 |
| 2490 | 1235 | GCCACCACCCUGGUGCUGA | UCAGCACCAGGGUGGUGGC | 6148 |
| 623 | 1236 | CCCACUAAUGUCCAGCGUU | AACGCUGGACAUUAGUGGG | 6149 |
| 339 | 1237 | ACUGGCAGCAACAGUCUUA | UAAGACUGUUGCUGCCAGU | 6150 |
| 2946 | 1238 | AUCUGAAUAAAGUGUAACA | UGUUACACUUUAUUCAGAU | 6151 |
| 1654 | 1239 | GCCUGCCAUCUGUGCUCUU | AAGAGCACAGAUGGCAGGC | 6152 |
| 1033 | 1240 | CAUUACAACUCUCCACAAC | GUUGUGGAGAGUUGUAAUG | 6153 |
| 840 | 1241 | CUCCUCAGAUGGUGUCUGC | GCAGACACCAUCUGAGGAG | 6154 |
| 1880 | 1242 | CAGUUGCUUGUUCGUGCAC | GUGCACGAACAAGCAACUG | 6155 |
| 420 | 1243 | AUCCUGAGGAAGAGGAUGU | ACAUCCUCUUCCUCAGGAU | 6156 |
| 1005 | 1244 | CACCAGUGGAUUCUGUGUU | AACACAGAAUCCACUGGUG | 6157 |
| 1193 | 1245 | CAAGAAAGCAAGCUCAUCA | UGAUGAGCUUGCUUUCUUG | 6158 |
| 919 | 1246 | CUUGCAUAACCUUUCCCAU | AUGGGAAAGGUUAUGCAAG | 6159 |
| 1727 | 1247 | CUUCACUAUGGACUACCAG | CUGGUAGUCCAUAGUGAAG | 6160 |
| 1883 | 1248 | UUGCUUGUUCGUGCACAUC | GAUGUGCACGAACAAGCAA | 6161 |
| 859 | 1249 | UAUUGUACGUACCAUGCAG | CUGCAUGGUACGUACAAUA | 6162 |
| 1812 | 1250 | GAAAUCUUGCCCUUUGUCC | GGACAAAGGGCAAGAUUUC | 6163 |
| 1605 | 1251 | CUCUUGUGCGUACUGUCCU | AGGACAGUACGCACAAGAG | 6164 |
| 2021 | 1252 | CACAACCGAAUUGUUAUCA | UGAUAACAAUUCGGUUGUG | 6165 |
| 2180 | 1253 | GCUCCUCUGACAGAGUUAC | GUAACUCUGUCAGAGGAGC | 6166 |
| 636 | 1254 | AGCGUUUGGCUGAACCAUC | GAUGGUUCAGCCAAACGCU | 6167 |
| 2282 | 1255 | AAACGGCUUUCAGUUGAGC | GCUCAACUGAAAGCCGUUU | 6168 |
| 1824 | 1256 | UUUGUCCCGCAAAUCAUGC | GCAUGAUUUGCGGGACAAA | 6169 |
| 2204 | 1257 | UCUAGGAAUGAAGGUGUGG | CCACACCUUCAUUCCUAGA | 6170 |
| 450 | 1258 | AAGUCCUGUAUGAGUGGGA | UCCCACUCAUACAGGACUU | 6171 |
| 1001 | 1259 | GGUUCACCAGUGGAUUCUG | CAGAAUCCACUGGUGAACC | 6172 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1579 | 1260 | GGUCUGCCAAGUGGGUGGU | ACCACCCACUUGGCAGACC | 6173 |
| 2179 | 1261 | AGCUCCUCUGACAGAGUUA | UAACUCUGUCAGAGGAGCU | 6174 |
| 376  | 1262 | UUCUGGUGCCACUACCACA | UGUGGUAGUGGCACCAGAA | 6175 |
| 556  | 1263 | UGCUAUGUUCCUGAGACA  | UGUCUCAGGGAACAUAGCA | 6176 |
| 1804 | 1264 | AUUGAUUCGAAAUCUUGCC | GGCAAGAUUUCGAAUCAAU | 6177 |
| 2552 | 1265 | CUCAUGGAUGGGCUGCCUC | GAGGCAGCCCAUCCAUGAG | 6178 |
| 2071 | 1266 | GCUGCUUUAUUCUCCCAUU | AAUGGGAGAAUAAAGCAGC | 6179 |
| 1836 | 1267 | AUCAUGCACCUUUGCGUGA | UCACGCAAAGGUGCAUGAU | 6180 |
| 336  | 1268 | GUCACUGGCAGCAACAGUC | GACUGUUGCUGCCAGUGAC | 6181 |
| 460  | 1269 | UGAGUGGGAACAGGGAUUU | AAAUCCCUGUUCCCACUCA | 6182 |
| 1559 | 1270 | AAUUAUAAGAACAAGAUGA | UCAUCUUGUUCUUAUAAUU | 6183 |
| 3136 | 1271 | UGGACAGUUUACCAGUUGC | GCAACUGGUAAACUGUCCA | 6184 |
| 1250 | 1272 | AUGAGGACCUAUACUUACG | CGUAAGUAUAGGUCCUCAU | 6185 |
| 1462 | 1273 | GGAAGGUCUCCUUGGGACU | AGUCCCAAGGAGACCUUCC | 6186 |
| 1965 | 1274 | UGGAAGAAAUAGUUGAAGG | CCUUCAACUAUUUCUUCCA | 6187 |
| 3114 | 1275 | GGUGUUAUUUGGAACCUUG | CAAGGUUCCAAAUAACACC | 6188 |
| 1665 | 1276 | GUGCUCUUCGUCAUCUGAC | GUCAGAUGACGAAGAGCAC | 6189 |
| 304  | 1277 | GGCCAUGGAACCAGACAGA | UCUGUCUGGUUCCAUGGCC | 6190 |
| 327  | 1278 | CGGCUGUUAGUCACUGGCA | UGCCAGUGACUAACAGCCG | 6191 |
| 1866 | 1279 | UUCCACGACUAGUUCAGUU | AACUGAACUAGUCGUGGAA | 6192 |
| 1699 | 1280 | AGCAGAGAUGGCCCAGAAU | AUUCUGGGCCAUCUCUGCU | 6193 |
| 2397 | 1281 | GCCAGGAUGAUCCUAGCUA | UAGCUAGGAUCAUCCUGGC | 6194 |
| 1658 | 1282 | GCCAUCUGUGCUCUUCGUC | GACGAAGAGCACAGAUGGC | 6195 |
| 891  | 1283 | UAGAAACAGCUCGUUGUAC | GUACAACGAGCUGUUUCUA | 6196 |
| 1572 | 1284 | AGAUGAUGGUCUGCCAAGU | ACUUGGCAGACCAUCAUCU | 6197 |
| 927  | 1285 | ACCUUUCCCAUCAUCGUGA | UCACGAUGAUGGGAAAGGU | 6198 |
| 290  | 1286 | AUGGAGUUGGACAUGGCCA | UGGCCAUGUCCAACUCCAU | 6199 |
| 1663 | 1287 | CUGUGCUCUUCGUCAUCUG | CAGAUGACGAAGAGCACAG | 6200 |
| 1562 | 1288 | UAUAAGAACAAGAUGAUGG | CCAUCAUCUUGUUCUUAUA | 6201 |
| 2947 | 1289 | UCUGAAUAAAGUGUAACAA | UUGUUACACUUUAUUCAGA | 6202 |
| 1711 | 1290 | CCAGAAUGCAGUUCGCCUU | AAGGCGAACUGCAUUCUGG | 6203 |
| 1566 | 1291 | AGAACAAGAUGAUGGUCUG | CAGACCAUCAUCUUGUUCU | 6204 |
| 1815 | 1292 | AUCUUGCCCUUUGUCCCGC | GCGGGACAAAGGGCAAGAU | 6205 |
| 1087 | 1293 | GCGUUUAGCUGGUGGGCUG | CAGCCCACCAGCUAAACGC | 6206 |
| 1495 | 1294 | GGGUUCAGAUGAUAUAAAU | AUUUAUAUCAUCUGAACCC | 6207 |
| 1363 | 1295 | UUUAGGACUUCACCUGACA | UGUCAGGUGAAGUCCUAAA | 6208 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 391 | 1296 | CACAGCUCCUUCUCUGAGU | ACUCAGAGAAGGAGCUGUG | 6209 |
| 1392 | 1297 | AACGUCUUGUUCAGAACUG | CAGUUCUGAACAAGACGUU | 6210 |
| 1935 | 1298 | CACAGCAGCAAUUUGUGGA | UCCACAAAUUGCUGCUGUG | 6211 |
| 1872 | 1299 | GACUAGUUCAGUUGCUUGU | ACAAGCAACUGAACUAGUC | 6212 |
| 1159 | 1300 | GACAGACUGCCUUCAAAUU | AAUUUGAAGGCAGUCUGUC | 6213 |
| 2308 | 1301 | CUCUCUCUUCAGAACAGAG | CUCUGUUCUGAAGAGAGAG | 6214 |
| 632 | 1302 | GUCCAGCGUUUGGCUGAAC | GUUCAGCCAAACGCUGGAC | 6215 |
| 1564 | 1303 | UAAGAACAAGAUGAUGGUC | GACCAUCAUCUUGUUCUUA | 6216 |
| 1384 | 1304 | UCCAAGUCAACGUCUUGUU | AACAAGACGUUGACUUGGA | 6217 |
| 1690 | 1305 | ACACCAAGAAGCAGAGAUG | CAUCUCUGCUUCUUGGUGU | 6218 |
| 1421 | 1306 | CUCAGGAAUCUUUCAGAUG | CAUCUGAAAGAUUCCUGAG | 6219 |
| 1141 | 1307 | UAAAUUCUUGGCUAUUACG | CGUAAUAGCCAAGAAUUUA | 6220 |
| 1732 | 1308 | CUAUGGACUACCAGUUGUG | CACAACUGGUAGUCCAUAG | 6221 |
| 634 | 1309 | CCAGCGUUUGGCUGAACCA | UGGUUCAGCCAAACGCUGG | 6222 |
| 932 | 1310 | UCCCAUCAUCGUGAGGGCU | AGCCCUCACGAUGAUGGGA | 6223 |
| 1366 | 1311 | AGGACUUCACCUGACAGAU | AUCUGUCAGGUGAAGUCCU | 6224 |
| 1608 | 1312 | UUGUGCGUACUGUCCUUCG | CGAAGGACAGUACGCACAA | 6225 |
| 1923 | 1313 | CCAUGGGUGGGACACAGCA | UGCUGUGUCCCACCCAUGG | 6226 |
| 1458 | 1314 | GGAUGGAAGGUCUCCUUGG | CCAAGGAGACCUUCCAUCC | 6227 |
| 1908 | 1315 | CCCAGCGCCGUACGUCCAU | AUGGACGUACGGCGCUGGG | 6228 |
| 539 | 1316 | GCUCAGAGGGUACGAGCUG | CAGCUCGUACCCUCUGAGC | 6229 |
| 2016 | 1317 | AUGUUCACAACCGAAUUGU | ACAAUUCGGUUGUGAACAU | 6230 |
| 1884 | 1318 | UGCUUGUUCGUGCACAUCA | UGAUGUGCACGAACAAGCA | 6231 |
| 560 | 1319 | AUGUUCCCUGAGACAUUAG | CUAAUGUCUCAGGGAACAU | 6232 |
| 411 | 1320 | GUAAAGGCAAUCCUGAGGA | UCCUCAGGAUUGCCUUUAC | 6233 |
| 338 | 1321 | CACUGGCAGCAACAGUCUU | AAGACUGUUGCUGCCAGUG | 6234 |
| 830 | 1322 | AUCAUGCGUUCUCCUCAGA | UCUGAGGAGAACGCAUGAU | 6235 |
| 3086 | 1323 | UAUGUAUGGGUAGGGUAAA | UUUACCCUACCCAUACAUA | 6236 |
| 3115 | 1324 | GUGUUAUUUGGAACCUUGU | ACAAGGUUCCAAAUAACAC | 6237 |
| 2177 | 1325 | ACAGCUCCUCUGACAGAGU | ACUCUGUCAGAGGAGCUGU | 6238 |
| 1733 | 1326 | UAUGGACUACCAGUUGUGG | CCACAACUGGUAGUCCAUA | 6239 |
| 375 | 1327 | AUUCUGGUGCCACUACCAC | GUGGUAGUGGCACCAGAAU | 6240 |
| 2565 | 1328 | UGCCUCCAGGUGACAGCAA | UUGCUGUCACCUGGAGGCA | 6241 |
| 442 | 1329 | UACCUCCCAAGUCCUGUAU | AUACAGGACUUGGGAGGUA | 6242 |
| 819 | 1330 | CCAGACACGCUAUCAUGCG | CGCAUGAUAGCGUGUCUGG | 6243 |
| 700 | 1331 | UGAUGCAGAACUUGCCACA | UGUGGCAAGUUCUGCAUCA | 6244 |
| 1089 | 1332 | GUUUAGCUGGUGGGCUGCA | UGCAGCCCACCAGCUAAAC | 6245 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1580 | 1333 | GUCUGCCAAGUGGGUGGUA | UACCACCCACUUGGCAGAC | 6246 |
| 1982 | 1334 | GGUUGUACCGGAGCCCUUC | GAAGGGCUCCGGUACAACC | 6247 |
| 1986 | 1335 | GUACCGGAGCCCUUCACAU | AUGUGAAGGGCUCCGGUAC | 6248 |
| 418 | 1336 | CAAUCCUGAGGAAGAGGAU | AUCCUCUUCCUCAGGAUUG | 6249 |
| 1306 | 1337 | GCUAUCUGUCUGCUCUAGU | ACUAGAGCAGACAGAUAGC | 6250 |
| 1377 | 1338 | UGACAGAUCCAAGUCAACG | CGUUGACUUGGAUCUGUCA | 6251 |
| 2467 | 1339 | CAUGAUGGAACAUGAGAUG | CAUCUCAUGUUCCAUCAUG | 6252 |
| 1414 | 1340 | UUGGACUCUCAGGAAUCUU | AAGAUUCCUGAGAGUCCAA | 6253 |
| 1668 | 1341 | CUCUUCGUCAUCUGACCAG | CUGGUCAGAUGACGAAGAG | 6254 |
| 1818 | 1342 | UUGCCCUUUGUCCCGCAAA | UUUGCGGGACAAAGGGCAA | 6255 |
| 1697 | 1343 | GAAGCAGAGAUGGCCCAGA | UCUGGGCCAUCUCUGCUUC | 6256 |
| 918 | 1344 | CCUUGCAUAACCUUUCCCA | UGGGAAAGGUUAUGCAAGG | 6257 |
| 605 | 1345 | CAGUUUGAUGCUGCUCAUC | GAUGAGCAGCAUCAAACUG | 6258 |
| 1374 | 1346 | ACCGACAGAUCCAAGUCA | UGACUUGGAUCUGUCAGGU | 6259 |
| 1430 | 1347 | CUUUCAGAUGCUGCAACUA | UAGUUGCAGCAUCUGAAAG | 6260 |
| 3186 | 1348 | GAUACGAUGCUUCAAGAGA | UCUCUUGAAGCAUCGUAUC | 6261 |
| 1355 | 1349 | AUGCAAGCUUUAGGACUUC | GAAGUCCUAAAGCUUGCAU | 6262 |
| 433 | 1350 | GGAUGUGGAUACCUCCCAA | UUGGGAGGUAUCCACAUCC | 6263 |
| 1713 | 1351 | AGAAUGCAGUUCGCCUUCA | UGAAGGCGAACUGCAUUCU | 6264 |
| 1811 | 1352 | CGAAAUCUUGCCCUUUGUC | GACAAAGGGCAAGAUUUCG | 6265 |
| 491 | 1353 | ACUCAAGAACAAGUAGCUG | CAGCUACUUGUUCUUGAGU | 6266 |
| 2209 | 1354 | GAAUGAAGGUGUGGCGACA | UGUCGCCACACCUUCAUUC | 6267 |
| 1840 | 1355 | UGCACCUUUGCGUGAGCAG | CUGCUCACGCAAAGGUGCA | 6268 |
| 550 | 1356 | ACGAGCUGCUAUGUUCCCU | AGGGAACAUAGCAGCUCGU | 6269 |
| 429 | 1357 | AAGAGGAUGUGGAUACCUC | GAGGUAUCCACAUCCUCUU | 6270 |
| 2436 | 1358 | GAUAUGGCCAGGAUGCCUU | AAGGCAUCCUGGCCAUAUC | 6271 |
| 1597 | 1359 | UAUAGAGGCUCUUGUGCGU | ACGCACAAGAGCCUCUAUA | 6272 |
| 1496 | 1360 | GGUUCAGAUGAUAUAAAUG | CAUUUAUAUCAUCUGAACC | 6273 |
| 1456 | 1361 | AGGGAUGGAAGGUCUCCUU | AAGGAGACCUUCCAUCCCU | 6274 |
| 3159 | 1362 | UAUCCCAAAGUUGUUGUAA | UUACAACAACUUUGGGAUA | 6275 |
| 2309 | 1363 | UCUCUCUUCAGAACAGAGC | GCUCUGUUCUGAAGAGAGA | 6276 |
| 2300 | 1364 | CUGACCAGCUCUCUCUUCA | UGAAGAGAGAGCUGGUCAG | 6277 |
| 3177 | 1365 | ACCUGCUGUGAUACGAUGC | GCAUCGUAUCACAGCAGGU | 6278 |
| 1079 | 1366 | AUGGCAGUGCGUUUAGCUG | CAGCUAAACGCACUGCCAU | 6279 |
| 1383 | 1367 | AUCCAAGUCAACGCUCUUGU | ACAAGACGUUGACUUGGAU | 6280 |
| 2563 | 1368 | GCUGCCUCCAGGUGACAGC | GCUGUCACCUGGAGGCAGC | 6281 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 1084 | 1369 | AGUGCGUUUAGCUGGUGGG | CCCACCAGCUAAACGCACU | 6282 |
| 1329 | 1370 | AGCCGGCUAUUGUAGAAGC | GCUUCUACAAUAGCCGGCU | 6283 |
| 573 | 1371 | CAUUAGAUGAGGGCAUGCA | UGCAUGCCCUCAUCUAAUG | 6284 |
| 2213 | 1372 | GAAGGUGUGGCGACAUAUG | CAUAUGUCGCCACACCUUC | 6285 |
| 1587 | 1373 | AAGUGGGUGGUAUAGAGGC | GCCUCUAUACCACCCACUU | 6286 |
| 2166 | 1374 | CUGAGGGAGCCACAGCUCC | GGAGCUGUGGCUCCCUCAG | 6287 |
| 637 | 1375 | GCGUUUGGCUGAACCAUCA | UGAUGGUUCAGCCAAACGC | 6288 |
| 397 | 1376 | UCCUUCUCUGAGUGGUAAA | UUUACCACUCAGAGAAGGA | 6289 |
| 1718 | 1377 | GCAGUUCGCCUUCACUAUG | CAUAGUGAAGGCGAACUGC | 6290 |
| 2357 | 1378 | GGACUUGAUAUUGGUGCCC | GGGCACCAAUAUCAAGUCC | 6291 |
| 639 | 1379 | GUUUGGCUGAACCAUCACA | UGUGAUGGUUCAGCCAAAC | 6292 |
| 585 | 1380 | GCAUGCAGAUCCCAUCUAC | GUAGAUGGGAUCUGCAUGC | 6293 |
| 2519 | 1381 | GAUGGGCUGCCAGAUCUGG | CCAGAUCUGGCAGCCCAUC | 6294 |
| 1367 | 1382 | GGACUUCACCUGACAGAUC | GAUCUGUCAGGUGAAGUCC | 6295 |
| 1391 | 1383 | CAACGUCUUGUUCAGAACU | AGUUCUGAACAAGACGUUG | 6296 |
| 509 | 1384 | GAUAUUGAUGGACAGUAUG | CAUACUGUCCAUCAAUAUC | 6297 |
| 303 | 1385 | UGGCCAUGGAACCAGACAG | CUGUCUGGUUCCAUGGCCA | 6298 |
| 494 | 1386 | CAAGAACAAGUAGCUGAUA | UAUCAGCUACUUGUUCUUG | 6299 |
| 328 | 1387 | GGCUGUUAGUCACUGGCAG | CUGCCAGUGACUAACAGCC | 6300 |
| 2058 | 1388 | CAUUGUUUGUGCAGCUGCU | AGCAGCUGCACAAACAAUG | 6301 |
| 1447 | 1389 | UAAACAGGAAGGGAUGGAA | UUCCAUCCCUUCCUGUUUA | 6302 |
| 1563 | 1390 | AUAAGAACAAGAUGAUGGU | ACCAUCAUCUUGUUCUUAU | 6303 |
| 1350 | 1391 | GUGGAAUGCAAGCUUUAGG | CCUAAAGCUUGCAUUCCAC | 6304 |
| 2208 | 1392 | GGAAUGAAGGUGUGGCGAC | GUCGCCACACCUUCAUUCC | 6305 |
| 1689 | 1393 | GACACCAAGAAGCAGAGAU | AUCUCUGCUUCUUGGUGUC | 6306 |
| 1407 | 1394 | ACUGUCUUUGGACUCUCAG | CUGAGAGUCCAAAGACAGU | 6307 |
| 2137 | 1395 | GGACAAGGAAGCUGCAGAA | UUCUGCAGCUUCCUUGUCC | 6308 |
| 854 | 1396 | UCUGCUAUUGUACGUACCA | UGGUACGUACAAUAGCAGA | 6309 |
| 2070 | 1397 | AGCUGCUUUAUUCUCCCAU | AUGGGAGAAUAAAGCAGCU | 6310 |
| 545 | 1398 | AGGGUACGAGCUGCUAUGU | ACAUAGCAGCUCGUACCCU | 6311 |
| 1640 | 1399 | GAAGACAUCACUGAGCCUG | CAGGCUCAGUGAUGUCUUC | 6312 |
| 2012 | 1400 | CGGGAUGUUCACAACCGAA | UUCGGUUGUGAACAUCCCG | 6313 |
| 1684 | 1401 | CAGCCGACACCAAGAAGCA | UGCUUCUUGGUGUCGGCUG | 6314 |
| 2017 | 1402 | UGUUCACAACCGAAUUGUU | AACAAUUCGGUUGUGAACA | 6315 |
| 2307 | 1403 | GCUCUCUCUUCAGAACAGA | UCUGUUCUGAAGAGAGAGC | 6316 |
| 844 | 1404 | UCAGAUGGUGUCUGCUAUU | AAUAGCAGACACCAUCUGA | 6317 |
| 405 | 1405 | UGAGUGGUAAAGGCAAUCC | GGAUUGCCUUUACCACUCA | 6318 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 379 | 1406 | UGGUGCCACUACCACAGCU | AGCUGUGGUAGUGGCACCA | 6319 |
| 1825 | 1407 | UUGUCCCGCAAAUCAUGCA | UGCAUGAUUUGCGGGACAA | 6320 |
| 2495 | 1408 | CACC CUGGUGCUGACUAUC | GAUAGUCAGCACCAGGGUG | 6321 |
| 629 | 1409 | AAUGUCCAGCGUUUGGCUG | CAGCCAAACGCUGGACAUU | 6322 |
| 2561 | 1410 | GGGCUGCCUCCAGGUGACA | UGUCACCUGGAGGCAGCCC | 6323 |
| 2192 | 1411 | GAGUUACUUCACUCUAGGA | UCCUAGAGUGAAGUAACUC | 6324 |
| 1809 | 1412 | UUCGAAAUCUUGCCCUUUG | CAAAGGGCAAGAUUUCGAA | 6325 |
| 1596 | 1413 | GUAUAGAGGCUCUUGUGCG | CGCACAAGAGCCUCUAUAC | 6326 |
| 2298 | 1414 | AGCUGACCAGCUCUCUCUU | AAGAGAGAGCUGGUCAGCU | 6327 |
| 858 | 1415 | CUAUUGUACGUACCAUGCA | UGCAUGGUACGUACAAUAG | 6328 |
| 524 | 1416 | UAUGCAAUGACUCGAGCUC | GAGCUCGAGUCAUUGCAUA | 6329 |
| 2542 | 1417 | UGCCCAGGACCUCAUGGAU | AUCCAUGAGGUCCUGGGCA | 6330 |
| 498 | 1418 | AACAAGUAGCUGAUAUUGA | UCAAUAUCAGCUACUUGUU | 6331 |
| 414 | 1419 | AAGGCAAUCCUGAGGAAGA | UCUUCCUCAGGAUUGCCUU | 6332 |
| 1570 | 1420 | CAAGAUGAUGGUCUGCCAA | UUGGCAGACCAUCAUCUUG | 6333 |
| 1030 | 1421 | UGCCAUUACAACUCUCCAC | GUGGAGAGUUGUAAUGGCA | 6334 |
| 3087 | 1422 | AUGUAUGGGUAGGGUAAAU | AUUUACCCUACCCAUACAU | 6335 |
| 1664 | 1423 | UGUGCUCUUCGUCAUCUGA | UCAGAUGACGAAGAGCACA | 6336 |
| 1790 | 1424 | AAGGCUACUGUUGGAUUGA | UCAAUCCAACAGUAGCCUU | 6337 |
| 1615 | 1425 | UACUGUCCUUCGGGCUGGU | ACCAGCCCGAAGGACAGUA | 6338 |
| 774 | 1426 | AUAAGGCUGCAGUUAUGGU | ACCAUAACUGCAGCCUUAU | 6339 |
| 1672 | 1427 | UCGUCAUCUGACCAGCCGA | UCGGCUGGUCAGAUGACGA | 6340 |
| 3171 | 1428 | GUUGUAACCUGCUGUGAUA | UAUCACAGCAGGUUACAAC | 6341 |
| 2271 | 1429 | AAGAUUACAAGAAACGGCU | AGCCGUUUCUUGUAAUCUU | 6342 |
| 1183 | 1430 | UUAUGGCAACCAAGAAAGC | GCUUUCUUGGUUGCCAUAA | 6343 |
| 2512 | 1431 | UCCAGUUGAUGGGCUGCCA | UGGCAGCCCAUCAACUGGA | 6344 |
| 1931 | 1432 | GGGACACAGCAGCAAUUUG | CAAAUUGCUGCUGUGUCCC | 6345 |
| 2468 | 1433 | AUGAUGGAACAUGAGAUGG | CCAUCUCAUGUUCCAUCAU | 6346 |
| 3077 | 1434 | UAUUUGGGAUAUGUAUGGG | CCCAUACAUAUCCCAAAUA | 6347 |
| 2069 | 1435 | CAGCUGCUUUAUUCUCCCA | UGGGAGAAUAAAGCAGCUG | 6348 |
| 272 | 1436 | GCUACUCAAGCUGAUUUGA | UCAAAUCAGCUUGAGUAGC | 6349 |
| 564 | 1437 | UCCCUGAGACAUUAGAUGA | UCAUCUAAUGUCUCAGGGA | 6350 |
| 437 | 1438 | GUGGAUACCUCCCAAGUCC | GGACUUGGGAGGUAUCCAC | 6351 |
| 2206 | 1439 | UAGGAAUGAAGGUGUGGCG | CGCCACACCUUCAUUCCUA | 6352 |
| 2187 | 1440 | UGACAGAGUUACUUCACUC | GAGUGAAGUAACUCUGUCA | 6353 |
| 325 | 1441 | AGCGGCUGUUAGUCACUGG | CCAGUGACUAACAGCCGCU | 6354 |

TABLE 1b-continued

Various c-CTNNB1 siNA sense and antisense sequences corresponding to the identified target sequences in Table 1a.

| Target Site (human) | SEQ ID NO: | Sense Sequence | Antisense Sequence | SEQ ID NO: |
|---|---|---|---|---|
| 3222 | 1442 | AUGGUUCAGAAUUAAACUU | AAGUUUAAUUCUGAACCAU | 6355 |
| 2024 | 1443 | AACCGAAUUGUUAUCAGAG | CUCUGAUAACAAUUCGGUU | 6356 |
| 1858 | 1444 | GGGUGCCAUUCCACGACUA | UAGUCGUGGAAUGGCACCC | 6357 |
| 1574 | 1445 | AUGAUGGUCUGCCAAGUGG | CCACUUGGCAGACCAUCAU | 6358 |
| 1896 | 1446 | CACAUCAGGAUACCCAGCG | CGCUGGGUAUCCUGAUGUG | 6359 |
| 2207 | 1447 | AGGAAUGAAGGUGUGGCGA | UCGCCACACCUUCAUUCCU | 6360 |
| 1300 | 1448 | GAAGGUGCUAUCUGUCUGC | GCAGACAGAUAGCACCUUC | 6361 |
| 1192 | 1449 | CCAAGAAAGCAAGCUCAUC | GAUGAGCUUGCUUUCUUGG | 6362 |
| 551 | 1450 | CGAGCUGCUAUGUUCCCUG | CAGGGAACAUAGCAGCUCG | 6363 |
| 2498 | 1451 | CCUGGUGCUGACUAUCCAG | CUGGAUAGUCAGCACCAGG | 6364 |
| 1305 | 1452 | UGCUAUCUGUCUGCUCUAG | CUAGAGCAGACAGAUAGCA | 6365 |
| 1337 | 1453 | AUUGUAGAAGCUGGUGGAA | UUCCACCAGCUUCUACAAU | 6366 |

For each oligonucleotide of a target sequence, the two individual, complementary strands of the siNA were synthesized separately using solid phase synthesis, then purified separately by reversed phase solid phase extraction (SPE). The complementary strands were annealed to form the double strand (duplex) and delivered in the desired concentration and buffer of choice.

Briefly, the single strand oligonucleotides were synthesized using phosphoramidite chemistry on an automated solid-phase synthesizer, using procedures as are generally known in the art (see for example U.S. application Ser. No. 12/064,014). A synthesis column was packed with solid support derivatized with the first nucleoside residue (natural or chemically modified). Synthesis was initiated by detritylation of the acid labile 5'-O-dimethoxytrityl group to release the 5'-hydroxyl. A suitably protected phosphoramidite and a suitable activator in acetonitrile were delivered simultaneously to the synthesis column resulting in coupling of the amidite to the 5'-hydroxyl. The column was then washed with a solvent, such as acetonitrile. An oxidizing solution, such as an iodine solution was pumped through the column to oxidize the phosphite triester linkage P(III) to its phosphotriester P(V) analog. Unreacted 5'-hydroxyl groups were capped using reagents such as acetic anhydride in the presence of 2,6-lutidine and N-methylimidazole. The elongation cycle was resumed with the detritylation step for the next phosphoramidite incorporation. This process was repeated until the desired sequence was synthesized. The synthesis concluded with the final 5'-terminus protecting group (trityl or 5'-O-dimethoxytrityl).

Upon completion of the synthesis, the solid-support and associated oligonucleotide were dried under argon pressure or vacuum. Aqueous base was added and the mixture was heated to effect cleavage of the succinyl linkage, removal of the cyanoethyl phosphate protecting group, and deprotection of the exocyclic amine protection.

The following process was performed on single strands that do not contain ribonucleotides. After treating the solid support with the aqueous base, the mixture was filtered to separate the solid support from the deprotected crude synthesis material. The solid support was then rinsed with water, which is combined with the filtrate. The resultant basic solution allows for retention of the 5'-O-dimethoxytrityl group to remain on the 5' terminal position (trityl-on).

For single strands that contain ribonucleotides, the following process was performed. After treating the solid support with the aqueous base, the mixture was filtered to separate the solid support from the deprotected crude synthesis material. The solid support was then rinsed with dimethylsulfoxide (DMSO), which was combined with the filtrate. Fluoride reagent, such as triethylamine trihydrofluoride, was added to the mixture, and the solution was heated. The reaction was quenched with suitable buffer to provide a solution of crude single strand with the 5'-O-dimethoxytrityl group on the final 5' terminal position.

The trityl-on solution of each crude single strand was purified using chromatographic purification, such as SPE RPC purification. The hydrophobic nature of the trityl group permits stronger retention of the desired full-length oligo than the non-tritylated truncated failure sequences. The failure sequences were selectively washed from the resin with a suitable solvent, such as low percent acetonitrile. Retained oligonucleotides were then detritylated on-column with trifluoroacetic acid to remove the acid-labile trityl group. Residual acid was washed from the column, a salt exchange was performed, and a final desalting of the material commenced. The full-length oligo was recovered in a purified form with an aqueous-organic solvent. The final product was then analyzed for purity (HPLC), identity (Maldi-TOF MS), and yield (UV $A_{260}$). The oligos were dried via lyophilization or vacuum condensation.

Annealing:

Based on the analysis of the product, the dried oligos were dissolved in appropriate buffers followed by mixing equal molar amounts (calculated using the theoretical extinction coefficient) of the sense and antisense oligonucleotide strands. The solution was then analyzed for purity of duplex by chromatographic methods and desired final concentration. If the analysis indicated an excess of either strand, then the additional non-excess strand was titrated until duplexing was complete. When analysis indicated that the target product purity has been achieved the material was delivered and ready for use.

Below is a table showing various modified siNAs synthesized using this protocol or that can be synthesized using this protocol or using methods known in the art.

TABLE 1c

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008247452-000C | 535 | 1 | UCGAGCUCAGAGGGUACGA | B ucGAGcucAGAGGGuAcGATT B | 1454 |
| R-008247452-000C | 535 | 1 | UCGAGCUCAGAGGGUACGA | UCGuAcccucuGAGcucGAUU | 1455 |
| R-008247449-000W | 1601 | 2 | GAGGCUCUUGUGCGUACUG | B GAGGcucuuGuGcGuAcuGTT B | 1456 |
| R-008247449-000W | 1601 | 2 | GAGGCUCUUGUGCGUACUG | CAGuAcGcAcAAGAGccucUU | 1457 |
| R-008247575-000Y | 1709 | 3 | GCCCAGAAUGCAGUUCGCC | B GcccAGAAuGcAGuucGccTT B | 1458 |
| R-008247575-000Y | 1709 | 3 | GCCCAGAAUGCAGUUCGCC | GGCGAAcuGcAuucuGGGcUU | 1459 |
| R-008247572-000X | 536 | 4 | CGAGCUCAGAGGGUACGAG | B cGAGcucAGAGGGuAcGAGTT B | 1460 |
| R-008247572-000X | 536 | 4 | CGAGCUCAGAGGGUACGAG | CUCGuAcccucuGAGcucGUU | 1461 |
| R-008247569-000R | 1797 | 5 | CUGUUGGAUUGAUUCGAAA | UUUcGAAucAAuccAAcAGUU | 1463 |
| R-008247569-000R | 1797 | 5 | CUGUUGGAUUGAUUCGAAA | B cuGuuGGAuuGAuucGAAATT B | 1462 |
| R-008247446-000V | 853 | 6 | GUCUGCUAUUGUACGUACC | B GucuGcuAuuGuAcGuAccTT B | 1464 |
| R-008247446-000V | 853 | 6 | GUCUGCUAUUGUACGUACC | GGUAcGuAcAAuAGcAGAcUU | 1465 |
| R-008247566-000P | 1143 | 7 | AAUUCUUGGCUAUUACGAC | GUCGuAuAGccAAGAAuuUU | 1467 |
| R-008247566-000P | 1143 | 7 | AAUUCUUGGCUAUUACGAC | B AAuucuuGGcuAuuAcGAcTT B | 1466 |
| R-008247563-000N | 2014 | 8 | GGAUGUUCACAACCGAAUU | B GGAuGuucAcAAccGAAuuTT B | 1468 |
| R-008247563-000N | 2014 | 8 | GGAUGUUCACAACCGAAUU | AAUucGGuuGuGAAcAuccUU | 1469 |
| R-008247560-000M | 520 | 9 | ACAGUAUGCAAUGACUCGA | B AcAGuAuGcAAuGAcucGATT B | 1470 |
| R-008247560-000M | 520 | 9 | ACAGUAUGCAAUGACUCGA | UCGAGucAuuGcAuAcuGuUU | 1471 |
| R-008247443-000U | 814 | 10 | AGCUUCCAGACACGCUAUC | B AGcuuccAGAcAcGcuAucTT B | 1472 |
| R-008247443-000U | 814 | 10 | AGCUUCCAGACACGCUAUC | GAUAGcGuGucuGGAAGcuUU | 1473 |
| R-008247440-000T | 852 | 11 | UGUCUGCUAUUGUACGUAC | GUAcGuAcAAuAGcAGAcAUU | 1475 |
| R-008247440-000T | 852 | 11 | UGUCUGCUAUUGUACGUAC | B uGucuGcuAuuGuAcGuAcTT B | 1474 |
| R-008247557-000F | 1796 | 12 | ACUGUUGGAUUGAUUCGAA | UUCGAAucAAuccAAcAGuUU | 1477 |
| R-008247557-000F | 1796 | 12 | ACUGUUGGAUUGAUUCGAA | B AcuGuuGGAuuGAuucGAATT B | 1476 |
| R-008247437-000L | 1901 | 13 | CAGGAUACCCAGCGCCGUA | UACGGcGcuGGGuAuccuGUU | 1479 |
| R-008247437-000L | 1901 | 13 | CAGGAUACCCAGCGCCGUA | B cAGGAuAcccAGcGccGuATT B | 1478 |
| R-008247554-000E | 822 | 14 | GACACGCUAUCAUGCGUUC | B GAcAcGcuAucAuGcGuucTT B | 1480 |
| R-008247554-000E | 822 | 14 | GACACGCUAUCAUGCGUUC | GAAcGcAuGAuAGcGuGucUU | 1481 |
| R-008247551-000D | 1795 | 15 | UACUGUUGGAUUGAUUCGA | UCGAAucAAuccAAcAGuAUU | 1483 |
| R-008247551-000D | 1795 | 15 | UACUGUUGGAUUGAUUCGA | B uAcuGuuGGAuuGAuucGATT B | 1482 |
| R-008247548-000X | 1145 | 16 | UUCUUGGCUAUUACGACAG | B uucuuGGcuAuuAcGAcAGTT B | 1484 |
| R-008247548-000X | 1145 | 16 | UUCUUGGCUAUUACGACAG | CUGucGuAuAGccAAGAAUU | 1485 |
| R-008247545-000W | 823 | 17 | ACACGCUAUCAUGCGUUCU | B AcAcGcuAucAuGcGuucuTT B | 1486 |
| R-008247545-000W | 823 | 17 | ACACGCUAUCAUGCGUUCU | AGAAcGcAuGAuAGcGuGuUU | 1487 |
| R-008247434-000K | 820 | 18 | CAGACACGCUAUCAUGCGU | B cAGAcAcGcuAucAuGcGuTT B | 1488 |
| R-008247434-000K | 820 | 18 | CAGACACGCUAUCAUGCGU | ACGcAuGAuAGcGuGucuGUU | 1489 |
| R-008247431-000J | 1798 | 19 | UGUUGGAUUGAUUCGAAAU | B uGuuGGAuuGAuucGAAAuTT B | 1490 |
| R-008247431-000J | 1798 | 19 | UGUUGGAUUGAUUCGAAAU | AUUucGAAucAAuccAAcAUU | 1491 |
| R-008247428-000C | 1380 | 20 | CAGAUCCAAGUCAACGUCU | B cAGAuccAAGucAAcGucuTT B | 1492 |
| R-008247428-000C | 1380 | 20 | CAGAUCCAAGUCAACGUCU | AGAcGuuGAcuuGGAucuGUU | 1493 |
| R-008247542-000V | 1602 | 21 | AGGCUCUUGUGCGUACUGU | B AGGcucuuGuGcGuAcuGuTT B | 1494 |
| R-008247542-000V | 1602 | 21 | AGGCUCUUGUGCGUACUGU | ACAGuAcGcAcAAGAGccuUU | 1495 |
| R-008247539-000N | 1612 | 22 | GCGUACUGUCCUUCGGGCU | B GcGuAcuGuccuucGGGcuTT B | 1496 |
| R-008247539-000N | 1612 | 22 | GCGUACUGUCCUUCGGGCU | AGCccGAAGGAcAGuAcGcUU | 1497 |
| R-008247425-000B | 626 | 23 | ACUAAUGUCCAGCGUUUGG | B AcuAAuGuccAGcGuuuGGTT B | 1498 |
| R-008247425-000B | 626 | 23 | ACUAAUGUCCAGCGUUUGG | CCAAAcGcuGGAcAuuAGuUU | 1499 |
| R-008247536-000M | 2000 | 24 | CACAUCCUAGCUCGGGAUG | B cAcAuccuAGcucGGGAuGTT B | 1500 |
| R-008247536-000M | 2000 | 24 | CACAUCCUAGCUCGGGAUG | CAUcccGAGcuAGGAuGuGUU | 1501 |
| R-008247422-000A | 2665 | 25 | GUUGCUGAGAGGGCUCGAG | B GuuGcuGAGAGGGcucGAGTT B | 1502 |
| R-008247422-000A | 2665 | 25 | GUUGCUGAGAGGGCUCGAG | CUCGAGcccucucAGcAAcUU | 1503 |
| R-008247533-000L | 1676 | 26 | CAUCUGACCAGCCGACACC | GGUGucGGcuGGucAGAuGUU | 1505 |
| R-008247533-000L | 1676 | 26 | CAUCUGACCAGCCGACACC | B cAucuGAccAGccGAcAccTT B | 1504 |
| R-008247530-000K | 1611 | 27 | UGCGUACUGUCCUUCGGGC | B uGcGuAcuGuccuucGGGcTT B | 1506 |
| R-008247530-000K | 1611 | 27 | UGCGUACUGUCCUUCGGGC | GCCcGAAGGAcAGuAcGcAUU | 1507 |
| R-008247419-000U | 2269 | 28 | ACAAGAUUACAAGAAACGG | B AcAAGAuuAcAAGAAAcGGTT B | 1508 |
| R-008247419-000U | 2269 | 28 | ACAAGAUUACAAGAAACGG | CCGuuucuuGuAAucuuGuUU | 1509 |
| R-008247527-000D | 674 | 29 | GUUGUAAACUUGAUUAACU | B GuuGuAAAcuuGAuuAAcuTT B | 1510 |
| R-008247527-000D | 674 | 29 | GUUGUAAACUUGAUUAACU | AGUuAAcAAGuuuAcAAcUU | 1511 |
| R-008247602-000K | 678 | 30 | UAAACUUGAUUAACUAUCA | B uAAAcuuGAuuAAcuAucATT B | 1512 |
| R-008247602-000K | 678 | 30 | UAAACUUGAUUAACUAUCA | UGAuAGuuAAucAAGuuuAUU | 1513 |
| R-008247599-000T | 1245 | 31 | AUAUAAUGAGGACCUAUAC | B AuAuAAuGAGGAccuAuAcTT B | 1514 |
| R-008247599-000T | 1245 | 31 | AUAUAAUGAGGACCUAUAC | GUAuAGGuccucAuuAuAuUU | 1515 |
| R-008247596-000S | 679 | 32 | AAACUUGAUUAACUAUCAA | B AAAcuuGAuuAAcuAucAATT B | 1516 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008247596-000S | 679 | 32 | AAACUUGAUUAACUAUCAA | UUGAuAGuuAAucAAGuuuUU | 1517 |
| R-008247593-000R | 1970 | 33 | GAAAUAGUUGAAGGUUGUA | B GAAAuAGuuGAAGGuuGAUU B | 1518 |
| R-008247593-000R | 1970 | 33 | GAAAUAGUUGAAGGUUGUA | UACAAccuucAAcuAuuucUU | 1519 |
| R-008247590-000P | 1247 | 34 | AUAAUGAGGACCUAUACUU | AAGuAuAGGuccucAuuAuUU | 1521 |
| R-008247590-000P | 1247 | 34 | AUAAUGAGGACCUAUACUU | B AuAAuGAGGAccuAuAcuuTT B | 1520 |
| R-008247464-000M | 1140 | 35 | UUUAAAUUCUUGGCUAUUAC | B uuAAAuucuuGGcuAuuAcTT B | 1522 |
| R-008247464-000M | 1140 | 35 | UUUAAAUUCUUGGCUAUUAC | GUAAuAGccAAGAAuuuAAUU | 1523 |
| R-008247587-000H | 676 | 36 | UGUAAACUUGAUUAACUAU | B uGuAAAcuuGAuuAAcuAuTT B | 1524 |
| R-008247587-000H | 676 | 36 | UGUAAACUUGAUUAACUAU | AUAGuuAAucAAGuuuAcAUU | 1525 |
| R-008247461-000L | 677 | 37 | GUAAACUUGAUUAACUAUC | GAUAGuuAAucAAGuuuAcUU | 1527 |
| R-008247461-000L | 677 | 37 | GUAAACUUGAUUAACUAUC | B GuAAAcuuGAuuAAcuAucTT B | 1526 |
| R-008247458-000E | 675 | 38 | UUGUAAACUUGAUUAACUA | B uuGuAAAcuuGAuuAAcuATT B | 1528 |
| R-008247458-000E | 675 | 38 | UUGUAAACUUGAUUAACUA | UAGuuAAucAAGuuuAcAAUU | 1529 |
| R-008247584-000G | 1235 | 39 | GCUUUAGUAAAUAUAAUGA | B GcuuuAGuAAAuAuAAuGATT B | 1530 |
| R-008247584-000G | 1235 | 39 | GCUUUAGUAAAUAUAAUGA | UCAuuAuAuuuAcuAAAGcUU | 1531 |
| R-008247581-000F | 2488 | 40 | UGGCCACCACCCUGGUGCU | B uGGccAccAcccuGGuGcuTT B | 1532 |
| R-008247581-000F | 2488 | 40 | UGGCCACCACCCUGGUGCU | AGCAccAGGGuGGuGGccAUU | 1533 |
| R-008247578-000Z | 1236 | 41 | CUUUAGUAAAUAUAAUGAG | B cuuuAGuAAAuAuAAuGAGTT B | 1534 |
| R-008247578-000Z | 1236 | 41 | CUUUAGUAAAUAUAAUGAG | CUCAuuAuAuuuAcuAAAGUU | 1535 |
| R-008247455-000D | 1237 | 42 | UUUAGUAAAUAUAAUGAGG | CCUcAuuAuAuuuAcuAAAUU | 1537 |
| R-008247455-000D | 1237 | 42 | UUUAGUAAAUAUAAUGAGG | B uuuAGuAAAuAuAAuGAGGTT B | 1536 |
| R-008042883-001A | 2555 | 43 | GUAAAUCGUCCUUUAGGUA | B GuAAAucGuccuuuAGGuATT B | 1538 |
| R-008042883-001A | 2555 | 43 | GUAAAUCGUCCUUUAGGUA | UACcuAAAGGAcGAuuuAcUU | 1539 |
| R-008308583-000P | 1545 | 44 | ACCUCACUUGCAAUAAUUA | B AccucAcuuGcAAuAAuuATT B | 1540 |
| R-008308583-000P | 1545 | 44 | ACCUCACUUGCAAUAAUUA | UAAuuAuuGcAAGuGAGGuUU | 1541 |
| R-008308520-000J | 2050 | 45 | UACCAUUCCAUUGUUUGUG | B uAccAuuccAuuGuuuGuGTT B | 1542 |
| R-008308520-000J | 2050 | 45 | UACCAUUCCAUUGUUUGUG | CACAAAcAAuGGAAuGGuAUU | 1543 |
| R-008308622-000L | 2097 | 46 | UCCAAAGAGUAGCUGCAGG | CCUGcAGcuAcucuuuGGAUU | 1545 |
| R-008308622-000L | 2097 | 46 | UCCAAAGAGUAGCUGCAGG | B uccAAAGAGuAGcuGcAGGTT B | 1544 |
| R-008308652-000N | 2510 | 47 | UAUCCAGUUGAUGGGCUGC | B uAuccAGuuGAuGGGcuGcTT B | 1546 |
| R-008308652-000N | 2510 | 47 | UAUCCAGUUGAUGGGCUGC | GCAGcccAucAAcuGGAuAUU | 1547 |
| R-008308718-000F | 871 | 48 | CAUGCAGAAUACAAAUGAU | AUCAuuuGuAuucuGcAuGUU | 1549 |
| R-008308718-000F | 871 | 48 | CAUGCAGAAUACAAAUGAU | B cAuGcAGAAuAcAAAuGAuTT B | 1548 |
| R-008308694-000A | 2098 | 49 | CCAAAGAGUAGCUGCAGGG | CCCuGcAGcuAcucuuuGGUU | 1551 |
| R-008308694-000A | 2098 | 49 | CCAAAGAGUAGCUGCAGGG | B ccAAAGAGuAGcuGcAGGGTT B | 1550 |
| R-008308517-000C | 1767 | 50 | CACCAUCCCACUGGCCUCU | B cAccAuccAcuGGccucuTT B | 1552 |
| R-008308517-000C | 1767 | 50 | CACCAUCCCACUGGCCUCU | AGAGGccAGuGGGAuGGuGUU | 1553 |
| R-008308619-000E | 869 | 51 | ACCAUGCAGAAUACAAAUG | B AccAuGcAGAAuAcAAAuGTT B | 1554 |
| R-008308619-000E | 869 | 51 | ACCAUGCAGAAUACAAAUG | CAUuuGuAuucuGcAuGGuUU | 1555 |
| R-008308514-000B | 1641 | 52 | AAGACAUCACUGAGCCUGC | B AAGAcAucAcuGAGccuGcTT B | 1556 |
| R-008308514-000B | 1641 | 52 | AAGACAUCACUGAGCCUGC | GCAGGcucAGuGAuGucuuUU | 1557 |
| R-008308616-000D | 2582 | 53 | AAUCAGCUGGCCUGGUUUG | B AAucAGcuGGccuGGuuuGTT B | 1558 |
| R-008308616-000D | 2582 | 53 | AAUCAGCUGGCCUGGUUUG | CAAAccAGGccAGcuGAuuUU | 1559 |
| R-008308580-000N | 1544 | 54 | AACCUCACUUGCAAUAAUU | AAUuAuuGcAAGuGAGGuuUU | 1561 |
| R-008308580-000N | 1544 | 54 | AACCUCACUUGCAAUAAUU | B AccucAcuuGcAAuAAuuTT B | 1560 |
| R-008308736-000Y | 2550 | 55 | ACCUCAUGGAUGGGCUGCC | B AccucAuGGAuGGGcuGccTT B | 1562 |
| R-008308736-000Y | 2550 | 55 | ACCUCAUGGAUGGGCUGCC | GGCAgcccAuccAuGAGGuUU | 1563 |
| R-008308613-000C | 2051 | 56 | ACCAUUCCAUUGUUUGUGC | GCAcAAAcAAuGGAAuGGuUU | 1565 |
| R-008308613-000C | 2051 | 56 | ACCAUUCCAUUGUUUGUGC | B AccAuuccAuuGuuuGuGcTT B | 1564 |
| R-008308577-000G | 870 | 57 | CCAUGCAGAAUACAAAUGA | UCAuuuGuAuucuGcAuGGUU | 1567 |
| R-008308577-000G | 870 | 57 | CCAUGCAGAAUACAAAUGA | B ccAuGcAGAAuAcAAAuGATT B | 1566 |
| R-008308691-000Z | 1670 | 58 | CUUCGUCAUCUGACCAGCC | B cuucGucAucuGAccAGccTT B | 1568 |
| R-008308691-000Z | 1670 | 58 | CUUCGUCAUCUGACCAGCC | GGCuGGucAGAuGAcGAAGUU | 1569 |
| R-008308649-000G | 2122 | 59 | CUGUGAACUUGCUCAGGAC | B cuGuGAAcuuGcucAGGAcTT B | 1570 |
| R-008308649-000G | 2122 | 59 | CUGUGAACUUGCUCAGGAC | GUCcuGAGcAAGuucAcAGUU | 1571 |
| R-008308553-000M | 1642 | 60 | AGACAUCACUGAGCCUGCC | B AGAcAucAcuGAGccuGccTT B | 1572 |
| R-008308553-000M | 1642 | 60 | AGACAUCACUGAGCCUGCC | GGCAGGcucAGuGAuGucuUU | 1573 |
| R-008308574-000F | 2324 | 61 | GAGCCAAUGGCUUGGAAUG | B GAGccAAuGGcuuGGAAuGTT B | 1574 |
| R-008308574-000F | 2324 | 61 | GAGCCAAUGGCUUGGAAUG | CAUuccAAGccAuuGGcucUU | 1575 |
| R-008308688-000T | 1649 | 62 | ACUGAGCCUGCCAUCUGUG | B AcuGAGccuGccAucuGuGTT B | 1576 |
| R-008308688-000T | 1649 | 62 | ACUGAGCCUGCCAUCUGUG | CACAGAuGGcAGGcucAGuUU | 1577 |
| R-008308550-000L | 2159 | 63 | AUUGAAGCUGAGGGAGCCA | B AuuGAAGcuGAGGGAGccATT B | 1578 |
| R-008308550-000L | 2159 | 63 | AUUGAAGCUGAGGGAGCCA | UGGcucccucAGcuucAAuUU | 1579 |
| R-008308511-000A | 785 | 64 | GUUAUGGUCCAUCAGCUUU | B GuuAuGGuccAucAGcuuuTT B | 1580 |
| R-008308511-000A | 785 | 64 | GUUAUGGUCCAUCAGCUUU | AAAGcuGAuGGAccAuAAcUU | 1581 |
| R-008308685-000S | 1511 | 65 | AAUGUGGUCACCUGUGCAG | B AAuGuGGucAccuGuGcAGTT B | 1582 |
| R-008308685-000S | 1511 | 65 | AAUGUGGUCACCUGUGCAG | CUGcAcAGGuGAccAcAuuUU | 1583 |
| R-008308610-000B | 2586 | 66 | AGCUGGCCUGGUUUGAUAC | B AGcuGGccuGGuuuGAuAcTT B | 1584 |
| R-008308610-000B | 2586 | 66 | AGCUGGCCUGGUUUGAUAC | GUAucAAAccAGGccAGcuUU | 1585 |
| R-008308571-000E | 642 | 67 | UGGCUGAACCAUCACAGAU | B uGGcuGAAccAucAcAGAuTT B | 1586 |
| R-008308571-000E | 642 | 67 | UGGCUGAACCAUCACAGAU | AUCuGuGAuGGuucAGccAUU | 1587 |
| R-008308715-000E | 1763 | 68 | CACCCACCAUCCCACUGGC | B cAcccAccAuccAcuGGcTT B | 1588 |
| R-008308715-000E | 1763 | 68 | CACCCACCAUCCCACUGGC | GCCAGuGGGAuGGuGGGuGUU | 1589 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008308682-000R | 2328 | 69 | CAAUGGCUUGGAAUGAGAC | GUCucAuuccAAGccAuuGUU | 1591 |
| R-008308682-000R | 2328 | 69 | CAAUGGCUUGGAAUGAGAC | B cAAuGGcuuGGAAuGAGAcTT B | 1590 |
| R-008308646-000F | 1280 | 70 | UGGACCACAAGCAGAGUGC | GCAcucuGcuuGuGGuccAUU | 1593 |
| R-008308646-000F | 1280 | 70 | UGGACCACAAGCAGAGUGC | B uGGAccAcAAGcAGAGuGcTT B | 1592 |
| R-008308508-000U | 2052 | 71 | CCAUUCCAUUGUUUGUGCA | B ccAuuccAuuGuuuGuGcATT B | 1594 |
| R-008308508-000U | 2052 | 71 | CCAUUCCAUUGUUUGUGCA | UGCAcAAAcAAuGGAuGGUU | 1595 |
| R-008308547-000E | 2546 | 72 | CAGGACCUCAUGGAUGGGC | GCCcAuccAuGAGGuccuGUU | 1597 |
| R-008308547-000E | 2546 | 72 | CAGGACCUCAUGGAUGGGC | B cAGGAccucAuGGAuGGGcTT B | 1596 |
| R-008308505-000T | 2124 | 73 | GUGAACUUGCUCAGGACAA | UUGuccuGAGcAAGuucAcUU | 1599 |
| R-008308505-000T | 2124 | 73 | GUGAACUUGCUCAGGACAA | B GuGAAcuuGcucAGGAcAATT B | 1598 |
| R-008308733-000X | 2545 | 74 | CCAGGACCUCAUGGAUGGG | CCCAuccAuGAGGuccuGGUU | 1601 |
| R-008308733-000X | 2545 | 74 | CCAGGACCUCAUGGAUGGG | B ccAGGAccucAuGGAuGGGTT B | 1600 |
| R-008308544-000D | 643 | 75 | GGCUGAACCAUCACAGAUG | B GGcuGAAccAucAcAGAuGTT B | 1602 |
| R-008308544-000D | 643 | 75 | GGCUGAACCAUCACAGAUG | CAUcuGuGAuGGuucAGccUU | 1603 |
| R-008308643-000E | 2501 | 76 | GGUGCUGACUAUCCAGUUG | B GGuGcuGAcuAuccAGuuGTT B | 1604 |
| R-008308643-000E | 2501 | 76 | GGUGCUGACUAUCCAGUUG | CAAcuGGAuAGucAGcAccUU | 1605 |
| R-008308712-000D | 2330 | 77 | AUGGCUUGGAAUGAGACUG | B AuGGcuuGGAAuGAGAcuGTT B | 1606 |
| R-008308712-000D | 2330 | 77 | AUGGCUUGGAAUGAGACUG | CAGucucAuuccAAGccAuUU | 1607 |
| R-008308568-000Y | 1638 | 78 | GGGAAGACAUCACUGAGCC | GGCucAGuGAuGucuucccUU | 1609 |
| R-008308568-000Y | 1638 | 78 | GGGAAGACAUCACUGAGCC | B GGGAAGAcAucAcuGAGccTT B | 1608 |
| R-008308640-000D | 1630 | 79 | UGGUGACAGGGAAGACAUC | B uGGuGAcAGGGAAGAcAucTT B | 1610 |
| R-008308640-000D | 1630 | 79 | UGGUGACAGGGAAGACAUC | GAUGucuuccccuGucAccAUU | 1611 |
| R-008308541-000C | 616 | 80 | UGCUCAUCCCACUAAUGUC | GACAuuAGuGGGAuGAGcAUU | 1613 |
| R-008308541-000C | 616 | 80 | UGCUCAUCCCACUAAUGUC | B uGcucAucccAcuAAuGucTT B | 1612 |
| R-008308679-000J | 2509 | 81 | CUAUCCAGUUGAUGGGCUG | B cuAuccAGuuGAuGGGcuGTT B | 1614 |
| R-008308679-000J | 2509 | 81 | CUAUCCAGUUGAUGGGCUG | CAGcccAucAAcuGGAuAGUU | 1615 |
| R-008308565-000X | 2548 | 82 | GGACCUCAUGGAUGGGCUG | B GGAccucAuGGAuGGGcuGTT B | 1616 |
| R-008308565-000X | 2548 | 82 | GGACCUCAUGGAUGGGCUG | CAGcccAuccAuGAGGuccUU | 1617 |
| R-008308538-000W | 1773 | 83 | CCCACUGGCCUCUGAUAAA | UUUAucAGAGGccAGuGGGUU | 1619 |
| R-008308538-000W | 1773 | 83 | CCCACUGGCCUCUGAUAAA | B cccAcuGGccucuGAuAAATT B | 1618 |
| R-008308535-000V | 2247 | 84 | UCCGAAUGUCUGAGGACAA | UUGuccucAGAcAuucGGAUU | 1621 |
| R-008308535-000V | 2247 | 84 | UCCGAAUGUCUGAGGACAA | B uccGAAuGucuGAGGAcAATT B | 1620 |
| R-008308637-000X | 2331 | 85 | UGGCUUGGAAUGAGACUGC | B uGGcuuGGAAuGAGAcuGcTT B | 1622 |
| R-008308637-000X | 2331 | 85 | UGGCUUGGAAUGAGACUGC | GCAGucucAuccAAGccAUU | 1623 |
| R-008309111-000F | 1498 | 86 | UUCAGAUGAUAUAAAUGUG | CACAuuuAuAucAucuGAAUU | 1625 |
| R-008309111-000F | 1498 | 86 | UUCAGAUGAUAUAAAUGUG | B uucAGAuGAuAuAAAuGuGTT B | 1624 |
| R-008309108-000Z | 2267 | 87 | CCACAAGAUUACAAGAAAC | B ccAcAAGAuuAcAAGAAAcTT B | 1626 |
| R-008309108-000Z | 2267 | 87 | CCACAAGAUUACAAGAAAC | GUUucuuGuAAucuuGuGGUU | 1627 |
| R-008308994-000E | 1547 | 88 | CUCACUUGCAAUAAUUAUA | UAUAAuuAuuGcAAGuGAGUU | 1629 |
| R-008308994-000E | 1547 | 88 | CUCACUUGCAAUAAUUAUA | B cucAcuuGcAAuAAuuAuATT B | 1628 |
| R-008309075-000K | 1549 | 89 | CACUUGCAAUAAUUAUAAG | CUUAuAAuuAuuGcAAGuGUU | 1631 |
| R-008309075-000K | 1549 | 89 | CACUUGCAAUAAUUAUAAG | B cAcuuGcAAuAAuuAuAAGTT B | 1630 |
| R-008309045-000H | 867 | 90 | GUACCAUGCAGAAUACAAA | UUUGuAuucuGcAuGGuAcUU | 1633 |
| R-008309045-000H | 867 | 90 | GUACCAUGCAGAAUACAAA | B GuAccAuGcAGAAuAcAAATT B | 1632 |
| R-008309072-000J | 1390 | 91 | UCAACGUCUUGUUCAGAAC | B ucAAcGucuuGuucAGAAcTT B | 1634 |
| R-008309072-000J | 1390 | 91 | UCAACGUCUUGUUCAGAAC | GUUcuGAAcAAGAcGuuGAUU | 1635 |
| R-008309027-000R | 593 | 92 | AUCCCAUCUACACAGUUUG | CAAAcuGuGuAGAuGGGAUU | 1637 |
| R-008309027-000R | 593 | 92 | AUCCCAUCUACACAGUUUG | B AucccAucuAcAcAGuuuGTT B | 1636 |
| R-008309009-000Y | 274 | 93 | UACUCAAGCUGAUUUGAUG | CAUcAAAucAGcuuGAGuAUU | 1639 |
| R-008309009-000Y | 274 | 93 | UACUCAAGCUGAUUUGAUG | B uAcucAAGcuGAuuuGAuGTT B | 1638 |
| R-008309024-000P | 759 | 94 | ACCAGGUGGUGGUUAAUAA | B AccAGGuGGuGGuuAAuAATT B | 1640 |
| R-008309024-000P | 759 | 94 | ACCAGGUGGUGGUUAAUAA | UUAuuAAccAccAccuGGuUU | 1641 |
| R-008309093-000C | 1439 | 95 | GCUGCAACUAAACAGGAAG | B GcuGcAAcuAAAcAGGAAGTT B | 1642 |
| R-008309093-000C | 1439 | 95 | GCUGCAACUAAACAGGAAG | CUUccuGuuuAGuuGcAGcUU | 1643 |
| R-008309069-000C | 1801 | 96 | UGGAUUGAUUCGAAAUCUU | B uGGAuuGAuucGAAAucuuTT B | 1644 |
| R-008309069-000C | 1801 | 96 | UGGAUUGAUUCGAAAUCUU | AAGAuuucGAAucAAuccAcUU | 1645 |
| R-008309021-000N | 1500 | 97 | CAGAUGAUAUAAAUGUGGU | B cAGAuGAuAuAAAuGuGGuTT B | 1646 |
| R-008309021-000N | 1500 | 97 | CAGAUGAUAUAAAUGUGGU | ACCAcAuuuAuAucAucuGUU | 1647 |
| R-008309066-000B | 848 | 98 | AUGGUGCUGCUAUUGUAC | B AuGGuGcuGcuAuuGuAcTT B | 1648 |
| R-008309066-000B | 848 | 98 | AUGGUGCUGCUAUUGUAC | GUAcAAuAGcAGcAccAuUU | 1649 |
| R-008309105-000Y | 2268 | 99 | CACAAGAUUACAAGAAACG | CGUuucuuGuAAucuuGuGUU | 1651 |
| R-008309105-000Y | 2268 | 99 | CACAAGAUUACAAGAAACG | B cAcAAGAuuAcAAGAAAcGTT B | 1650 |
| R-008309042-000G | 882 | 100 | CAAAUGAUGUAGAAACAGC | GCUGuuucuAcAucAuuuGUU | 1653 |
| R-008309042-000G | 882 | 100 | CAAAUGAUGUAGAAACAGC | B cAAAuGAuGuAGAAAcAGcTT B | 1652 |
| R-008309063-000A | 2266 | 101 | GCCACAAGAUUACAAGAAA | UUUcuuGuAAucuuGuGGcUU | 1655 |
| R-008309063-000A | 2266 | 101 | GCCACAAGAUUACAAGAAA | B GccAcAAGAuuAcAAGAAATT B | 1654 |
| R-008309018-000G | 880 | 102 | UACAAAUGAUGUAGAAACA | B uAcAAAuGAuGuAGAAAcATT B | 1656 |
| R-008309018-000G | 880 | 102 | UACAAAUGAUGUAGAAACA | UGUuucuAcAucAuuuGuAUU | 1657 |
| R-008309039-000A | 1810 | 103 | UCGAAAUCUUGCCCUUUGU | ACAAAGGGcAAGAuuucGAUU | 1659 |
| R-008309039-000A | 1810 | 103 | UCGAAAUCUUGCCCUUUGU | B ucGAAAucuuGcccuuuGuTT B | 1658 |
| R-008309015-000F | 685 | 104 | GAUUAACUAUCAAGAUGAU | B GAuuAAcuAucAAGAuGAuTT B | 1660 |
| R-008309015-000F | 685 | 104 | GAUUAACUAUCAAGAUGAU | AUCAucuuGAuAGuuAAucUU | 1661 |
| R-008309060-000Z | 1007 | 105 | CCAGUGGAUUCUGUGUUGU | ACAAcAcAGAAuccAcuGGUU | 1663 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008309060-000Z | 1007 | 105 | CCAGUGGAUUCUGUGUUGU | B ccAGuGGAuucuGuGuuGuTT B | 1662 |
| R-008309057-000T | 1789 | 106 | AAAGGCUACUGUUGGAUUG | B AAAGGcuAcuGuuGGAuuGTT B | 1664 |
| R-008309057-000T | 1789 | 106 | AAAGGCUACUGUUGGAUUG | CAAuccAAcAGuAGcuuuUU | 1665 |
| R-008309054-000S | 499 | 107 | ACAAGUAGCUGAUAUUGAU | AUCAAuAucAGcuAcuuGuUU | 1667 |
| R-008309054-000S | 499 | 107 | ACAAGUAGCUGAUAUUGAU | B AcAAGuAGcuGAuAuuGAuTT B | 1666 |
| R-008309090-000B | 2470 | 108 | GAUGGAACAUGAGAUGGGU | B GAuGGAAcAuGAGAuGGGuTT B | 1668 |
| R-008309090-000B | 2470 | 108 | GAUGGAACAUGAGAUGGGU | ACCcAucucAuGuuccAucUU | 1669 |
| R-008309051-000R | 694 | 109 | UCAAGAUGAUGCAGAACUU | B ucAAGAuGAuGcAGAAcuuTT B | 1670 |
| R-008309051-000R | 694 | 109 | UCAAGAUGAUGCAGAACUU | AAGuucuGcAucAucuuGAUU | 1671 |
| R-008309036-000Z | 278 | 110 | CAAGCUGAUUUGAUGGAGU | ACUccAucAAAucAGcuuGUU | 1673 |
| R-008309036-000Z | 278 | 110 | CAAGCUGAUUUGAUGGAGU | B cAAGcuGAuuuGAuGGAGuTT B | 1672 |
| R-008309102-000X | 1415 | 111 | UGGACUCUCAGGAAUCUUU | B uGGAcucucAGGAAucuuuTT B | 1674 |
| R-008309102-000X | 1415 | 111 | UGGACUCUCAGGAAUCUUU | AAAGAuuccuGAGAGuccAUU | 1675 |
| R-008308991-000D | 2046 | 112 | UAAAUACCAUUCCAUUGUU | AACAAuGGAAuGGuAuuuAUU | 1677 |
| R-008308991-000D | 2046 | 112 | UAAAUACCAUUCCAUUGUU | B uAAAuAccAuuccAuuGuuTT B | 1676 |
| R-008309006-000X | 1057 | 113 | AUUACAUCAAGAAGGAGCU | AGCuccuucuuGAuGuAAuUU | 1679 |
| R-008309006-000X | 1057 | 113 | AUUACAUCAAGAAGGAGCU | B AuuAcAucAAGAAGGAGcuTT B | 1678 |
| R-008309087-000V | 1422 | 114 | UCAGGAAUCUUUCAGAUGC | B ucAGGAAucuuucAGAuGcTT B | 1680 |
| R-008309087-000V | 1422 | 114 | UCAGGAAUCUUUCAGAUGC | GCAucuGAAAGAuuccuGAUU | 1681 |
| R-008309084-000U | 684 | 115 | UGAUUAACUAUCAAGAUGA | UCAucuuGAuAGuuAAucAUU | 1683 |
| R-008309084-000U | 684 | 115 | UGAUUAACUAUCAAGAUGA | B uGAuuAAcuAucAAGAuGATT B | 1682 |
| R-008309099-000E | 2197 | 116 | ACUUCACUCUAGGAAUGAA | B AcuucAcucuAGGAAuGAATT B | 1684 |
| R-008309099-000E | 2197 | 116 | ACUUCACUCUAGGAAUGAA | UUCAuuccuAGAGuGAAGuUU | 1685 |
| R-008309003-000W | 666 | 117 | AACAUGCAGUUGUAAACUU | B AAcAuGcAGuuGuAAAcuuTT B | 1686 |
| R-008309003-000W | 666 | 117 | AACAUGCAGUUGUAAACUU | AAGuuuAcAAcuGcAuGuuUU | 1687 |
| R-008309012-000E | 279 | 118 | AAGCUGAUUUGAUGGAGUU | AACuccAucAAAucAGcuuUU | 1689 |
| R-008309012-000E | 279 | 118 | AAGCUGAUUUGAUGGAGUU | B AAGcuGAuuuGAuGGAGuuTT B | 1688 |
| R-008309033-000Y | 1492 | 119 | UCUGGGUUCAGAUGAUAUA | B ucuGGGuucAGAuGAuAuATT B | 1690 |
| R-008309033-000Y | 1492 | 119 | UCUGGGUUCAGAUGAUAUA | UAUAucAucuGAAcccAGAUU | 1691 |
| R-008309081-000T | 2195 | 120 | UUACUUCACUCUAGGAAUG | CAUuccuAGAGuGAAGuAAUU | 1693 |
| R-008309081-000T | 2195 | 120 | UUACUUCACUCUAGGAAUG | B uuAcuucAcucuAGGAAuGTT B | 1692 |
| R-008309048-000J | 1424 | 121 | AGGAAUCUUUCAGAUGCUG | B AGGAAucuuucAGAuGcuGTT B | 1694 |
| R-008309048-000J | 1424 | 121 | AGGAAUCUUUCAGAUGCUG | CAGcAucuGAAAGAuuccuUU | 1695 |
| R-008309000-000V | 661 | 122 | GCUGAAACAUGCAGUUGUA | UACAAcuGcAuGuuucAGcUU | 1697 |
| R-008309000-000V | 661 | 122 | GCUGAAACAUGCAGUUGUA | B GcuGAAAcAuGcAGuuGuATT B | 1696 |
| R-008309078-000L | 1882 | 123 | GUUGCUUGUUCGUGCACAU | B GuuGcuuGuucGuGcAcAuTT B | 1698 |
| R-008309078-000L | 1882 | 123 | GUUGCUUGUUCGUGCACAU | AUGuGcAcGAAcAAGcAAcUU | 1699 |
| R-008309096-000D | 1966 | 124 | GGAAGAAAUAGUUGAAGGU | B GGAAGAAAuAGuuGAAGGuTT B | 1700 |
| R-008309096-000D | 1966 | 124 | GGAAGAAAUAGUUGAAGGU | ACCuucAAcuAuuucuuccUU | 1701 |
| R-008308997-000F | 2259 | 125 | AGGACAAGCCACAAGAUUA | B AGGAcAAGccAcAAGAuuATT B | 1702 |
| R-008308997-000F | 2259 | 125 | AGGACAAGCCACAAGAUUA | UAAucuuGuGGcuuGuccUU | 1703 |
| R-008309030-000X | 832 | 126 | CAUGCGUUCUCCUCAGAUG | B cAuGcGuucuccucAGAuGTT B | 1704 |
| R-008309030-000X | 832 | 126 | CAUGCGUUCUCCUCAGAUG | CAUcuGAGGAGAAcGcAuGUU | 1705 |
| R-008042849-001H | 2346 | 127 | GAUGAUCCCAGCUACCGUU | AACGGuAGcuGGGAucAucUU | 1707 |
| R-008042849-001H | 2346 | 127 | GAUGAUCCCAGCUACCGUU | B GAuGAucccAGcuAccGuuTT B | 1706 |
| R-008308601-000T | 1653 | 128 | AGCCUGCCAUCUGUGCUCU | B AGccuGccAucuGuGcucuTT B | 1708 |
| R-008308601-000T | 1653 | 128 | AGCCUGCCAUCUGUGCUCU | AGAGcAcAGAuGGcAGGcuUU | 1709 |
| R-008308562-000W | 2389 | 129 | UGGAUAUCGCCAGGAUGAU | B uGGAuAucGccAGGAuGAuTT B | 1710 |
| R-008308562-000W | 2389 | 129 | UGGAUAUCGCCAGGAUGAU | AUCAuccuGGcGAuAuccAUU | 1711 |
| R-008308709-000X | 1669 | 130 | UCUUCGUCAUCUGACCAGC | B ucuucGucAucuGAccAGcTT B | 1712 |
| R-008308709-000X | 1669 | 130 | UCUUCGUCAUCUGACCAGC | GCuGGucAGAuGAcGAAGAUU | 1713 |
| R-008308634-000W | 2123 | 131 | UGUGAACUUGCUCAGGACA | B uGuGAAcuuGcucAGGAcATT B | 1714 |
| R-008308634-000W | 2123 | 131 | UGUGAACUUGCUCAGGACA | UGUccGAGcAAGuucAcAUU | 1715 |
| R-008308667-000Z | 1521 | 132 | CCUGUGCAGCUGGAAUUCU | B ccuGuGcAGcuGGAAuucuTT B | 1716 |
| R-008308667-000Z | 1521 | 132 | CCUGUGCAGCUGGAAUUCU | AGAAuccAGcuGcAcAGGUU | 1717 |
| R-008308706-000W | 2125 | 133 | UGAACUUGCUCAGGACAAG | CUUGuccuGAGcAAGuucAUU | 1719 |
| R-008308706-000W | 2125 | 133 | UGAACUUGCUCAGGACAAG | B uGAAcuuGcucAGGAcAAGTT B | 1718 |
| R-008308724-000N | 2503 | 134 | UGCUGACUAUCCAGUUGAU | B uGcuGAcuAuccAGuuGAuTT B | 1720 |
| R-008308724-000N | 2503 | 134 | UGCUGACUAUCCAGUUGAU | AUCAAcuGGAuAGucAGcAUU | 1721 |
| R-008308703-000V | 1502 | 135 | GAUGAUAUAAAUGUGGUCA | UGAccAcAuuuAuAucAucUU | 1723 |
| R-008308703-000V | 1502 | 135 | GAUGAUAUAAAUGUGGUCA | B GAuGAuAuAAAuGuGGucATT B | 1722 |
| R-008308496-000Y | 2502 | 136 | GUGCUGACUAUCCAGUUGA | UCAAcuGGAuAGucAGcAcUU | 1725 |
| R-008308496-000Y | 2502 | 136 | GUGCUGACUAUCCAGUUGA | B GuGcuGAcuAuccAGuuGATT B | 1724 |
| R-008308625-000M | 2506 | 137 | UGACUAUCCAGUUGAUGGG | CCCAAcAAcuGGAuAGucAUU | 1727 |
| R-008308625-000M | 2506 | 137 | UGACUAUCCAGUUGAUGGG | B uGAcuAuccAGuuGAuGGGTT B | 1726 |
| R-008308589-000S | 2127 | 138 | AACUUGCUCAGGACAAGGA | B AAcuuGcucAGGAcAAGGATT B | 1728 |
| R-008308589-000S | 2127 | 138 | AACUUGCUCAGGACAAGGA | UCCuuGuccuGAGcAAGuuUU | 1729 |
| R-008308586-000R | 2505 | 139 | CUGACUAUCCAGUUGAUGG | B cuGAcuAuccAGuuGAuGGTT B | 1730 |
| R-008308586-000R | 2505 | 139 | CUGACUAUCCAGUUGAUGG | CCAucAAcuGGAuAGucAGUU | 1731 |
| R-008308493-000X | 617 | 140 | GCUCAUCCCACUAAUGUCC | B GcucAucccAcuAAuGuccTT B | 1732 |
| R-008308493-000X | 617 | 140 | GCUCAUCCCACUAAUGUCC | GGAcAuuAGuGGGAuGAGcUU | 1733 |
| R-008308697-000B | 2504 | 141 | GCUGACUAUCCAGUUGAUG | B GcuGAcuAuccAGuuGAuGTT B | 1734 |
| R-008308697-000B | 2504 | 141 | GCUGACUAUCCAGUUGAUG | CAUcAAcuGGAuAGucAGcUU | 1735 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008308661-000X | 1503 | 142 | AUGAUAUAAAUGUGGUCAC | GUGAccAcAuuuAuAucAuUU | 1737 |
| R-008308661-000X | 1503 | 142 | AUGAUAUAAAUGUGGUCAC | B AuGAuAuAAAuGuGGucAcTT B | 1736 |
| R-008308526-000L | 618 | 143 | CUCAUCCCACUAAUGUCCA | UGGAcAuuAGuGGGAuGAGUU | 1739 |
| R-008308526-000L | 618 | 143 | CUCAUCCCACUAAUGUCCA | B cucAucccAcuAAuGuccATT B | 1738 |
| R-008308556-000N | 2074 | 144 | GCUUUAUUCUCCCAUUGAA | B GcuuuAuucucccAuuGAATT B | 1740 |
| R-008308556-000N | 2074 | 144 | GCUUUAUUCUCCCAUUGAA | UUCAAuGGGAGAAuAAAGcUU | 1741 |
| R-008308523-000K | 2499 | 145 | CUGGUGCUGACUAUCCAGU | B cuGGuGcuGAcuAuccAGuTT B | 1742 |
| R-008308523-000K | 2499 | 145 | CUGGUGCUGACUAUCCAGU | ACUGGAuAGucAGcAccAGUU | 1743 |
| R-008362860-000A | 1406 | 146 | AACUGUCUUUGGACUCUCA | B AAcuGucuuuGGAcucucATT B | 1744 |
| R-008362860-000A | 1406 | 146 | AACUGUCUUUGGACUCUCA | UGAGAGuccAAAGAcAGuuUU | 1745 |
| R-008362809-000Z | 582 | 147 | AGGGCAUGCAGAUCCCAUC | GAUGGGAucuGcAuGcccuUU | 1747 |
| R-008362809-000Z | 582 | 147 | AGGGCAUGCAGAUCCCAUC | B AGGGcAuGcAGAucccAucTT B | 1746 |
| R-008362908-000A | 1505 | 148 | GAUAUAAAUGUGGUCACCU | B GAuAuAAAuGuGGucAccuTT B | 1748 |
| R-008362908-000A | 1505 | 148 | GAUAUAAAUGUGGUCACCU | AGGuAccAcAuuuAuAucUU | 1749 |
| R-008362713-000E | 1432 | 149 | UUCAGAUGCUGCAACUAAA | UUUAGuuGcAGcAucuGAAUU | 1751 |
| R-008362713-000E | 1432 | 149 | UUCAGAUGCUGCAACUAAA | B uucAGAuGcuGcAAcuAAATT B | 1750 |
| R-008363073-000K | 1968 | 150 | AAGAAAUAGUUGAAGGUUG | B AAGAAAuAGuuGAAGGuuGTT B | 1752 |
| R-008363073-000K | 1968 | 150 | AAGAAAUAGUUGAAGGUUG | CAAccuucAAcuAuuucuuUU | 1753 |
| R-008362947-000L | 2398 | 151 | CCAGGAUGAUCCUAGCUAU | B ccAGGAuGAuccuAGcuAuTT B | 1754 |
| R-008362947-000L | 2398 | 151 | CCAGGAUGAUCCUAGCUAU | AUAGcuAGGAucAuccuGGUU | 1755 |
| R-008363070-000J | 954 | 152 | UGGCCAUCUUUAAGUCUGG | CCAGAcuuAAAGAuGGccAUU | 1757 |
| R-008363070-000J | 954 | 152 | UGGCCAUCUUUAAGUCUGG | B uGGccAucuuuAAGucuGGTT B | 1756 |
| R-008362857-000U | 505 | 153 | AGCUGAUAUUGAUGGACAG | B AGcuGAuAuuGAuGGAcAGTT B | 1758 |
| R-008362857-000U | 505 | 153 | AGCUGAUAUUGAUGGACAG | CUGuccAucAAuAucAGcuUU | 1759 |
| R-008363067-000C | 2011 | 154 | UCGGGAUGUUCACAACCGA | B ucGGGAuGuucAcAAccGATT B | 1760 |
| R-008363067-000C | 2011 | 154 | UCGGGAUGUUCACAACCGA | UCGGuuGuGAAcAucccGAUU | 1761 |
| R-008362944-000K | 1339 | 155 | UGUAGAAGCUGGUGGAAUG | B uGuAGAAGcuGGuGGAAuGTT B | 1762 |
| R-008362944-000K | 1339 | 155 | UGUAGAAGCUGGUGGAAUG | CAUccAccAGcuucAcAUU | 1763 |
| R-008362761-000Z | 1242 | 156 | UAAAUAUAAUGAGGACCUA | B uAAAuAuAAuGAGGAccuATT B | 1764 |
| R-008362761-000Z | 1242 | 156 | UAAAUAUAAUGAGGACCUA | UAGGuccucAuuAuAuuuAUU | 1765 |
| R-008362758-000T | 567 | 157 | CUGAGACAUUAGAUGAGGG | B cuGAGAcAuuAGAuGAGGGTT B | 1766 |
| R-008362758-000T | 567 | 157 | CUGAGACAUUAGAUGAGGG | CCCucAucuAAuGucucAGUU | 1767 |
| R-008363007-000Y | 1240 | 158 | AGUAAAUAUAAUGAGGACC | B AGuAAAuAuAAuGAGGAccTT B | 1768 |
| R-008363007-000Y | 1240 | 158 | AGUAAAUAUAAUGAGGACC | GGUccucAuuAuAuuuAcuUU | 1769 |
| R-008362854-000T | 438 | 159 | UGGAUACCUCCCAAGUCCU | B uGGAuAccuccCAAGuccuTT B | 1770 |
| R-008362854-000T | 438 | 159 | UGGAUACCUCCCAAGUCCU | AGGAcuuGGGAGGuAuccAUU | 1771 |
| R-008362755-000S | 2445 | 160 | AGGAUGCCUUGGGUAUGGA | UCCAuAcccAAGGcAuccuUU | 1773 |
| R-008362755-000S | 2445 | 160 | AGGAUGCCUUGGGUAUGGA | B AGGAuGccuuGGGuAuGGATT B | 1772 |
| R-008363064-000B | 860 | 161 | AUUGUACGUACCAUGCAGA | B AuuGuAcGuAccAuGcAGATT B | 1774 |
| R-008363064-000B | 860 | 161 | AUUGUACGUACCAUGCAGA | UCUGcAuGGuAcGuAcAAuUU | 1775 |
| R-008362752-000R | 1413 | 162 | UUUGGACUCUCAGGAAUCU | B uuuGGAcucucAGGAAucuTT B | 1776 |
| R-008362752-000R | 1413 | 162 | UUUGGACUCUCAGGAAUCU | AGAuuccuGAGAGuccAAAUU | 1777 |
| R-008363061-000A | 1800 | 163 | UUGGAUUGAUUCGAAAUCU | AGAuuuucGAAucAAuccAAUU | 1779 |
| R-008363061-000A | 1800 | 163 | UUGGAUUGAUUCGAAAUCU | B uuGGAuuGAuucGAAAucuTT B | 1778 |
| R-008363004-000X | 2037 | 164 | UCAGAGGACUAAAUACCAU | AUGGuAuuuAGuccucuGAUU | 1781 |
| R-008363004-000X | 2037 | 164 | UCAGAGGACUAAAUACCAU | B ucAGAGGAcuAAAuAccAuTT B | 1780 |
| R-008362851-000S | 2443 | 165 | CCAGGAUGCCUUGGGUAUG | B ccAGGAuGccuuGGGuAuGTT B | 1782 |
| R-008362851-000S | 2443 | 165 | CCAGGAUGCCUUGGGUAUG | CAUAcccAAGGcAuccuGGUU | 1783 |
| R-008363001-000W | 2471 | 166 | AUGGAACAUGAGAUGGGUG | B AuGGAAcAuGAGAuGGGuGTT B | 1784 |
| R-008363001-000W | 2471 | 166 | AUGGAACAUGAGAUGGGUG | CACccAucucAuGuccAuUU | 1785 |
| R-008362905-000Z | 1792 | 167 | GGCUACUGUUGGAUUGAUU | B GGcuAcuGuuGGAuuGAuuTT B | 1786 |
| R-008362905-000Z | 1792 | 167 | GGCUACUGUUGGAUUGAUU | AAUcAAccAAcAGuAGccUU | 1787 |
| R-008362902-000Y | 2547 | 168 | AGGACCUCAUGGAUGGGCU | B AGGAccucAuGGAuGGGcuTT B | 1788 |
| R-008362902-000Y | 2547 | 168 | AGGACCUCAUGGAUGGGCU | AGCccAuccAuGAGGuccUU | 1789 |
| R-008362998-000G | 1662 | 169 | UCUGUGCUCUUCGUCAUCU | AGAuGAcGAAGAGcAcAGAUU | 1791 |
| R-008362998-000G | 1662 | 169 | UCUGUGCUCUUCGUCAUCU | B ucuGuGcucuucGucAucuTT B | 1790 |
| R-008362848-000K | 288 | 170 | UGAUGGAGUUGGACAUGGC | GCCAuGuccAAcuccAucAUU | 1793 |
| R-008362848-000K | 288 | 170 | UGAUGGAGUUGGACAUGGC | B uGAuGGAGuuGGAcAuGGcTT B | 1792 |
| R-008362710-000D | 579 | 171 | AUGAGGGCAUGCAGAUCCC | GGGAucuGcAuGcccucAuUU | 1795 |
| R-008362710-000D | 579 | 171 | AUGAGGGCAUGCAGAUCCC | B AuGAGGGcAuGcAGAucccTT B | 1794 |
| R-008362707-000X | 2508 | 172 | ACUAUCCAGUUGAUGGGCU | AGCccAucAAcuGGAuAGuUU | 1797 |
| R-008362707-000X | 2508 | 172 | ACUAUCCAGUUGAUGGGCU | B AcuAuccAGuuGAuGGGcuTT B | 1796 |
| R-008362806-000Y | 580 | 173 | UGAGGGCAUGCAGAUCCCA | B uGAGGGcAuGcAGAucccATT B | 1798 |
| R-008362806-000Y | 580 | 173 | UGAGGGCAUGCAGAUCCCA | UGGGAucuGcAuGcccucAUU | 1799 |
| R-008362803-000X | 2388 | 174 | UUGGAUAUCGCCAGGAUGA | B uuGGAuAucGccAGGAuGATT B | 1800 |
| R-008362803-000X | 2388 | 174 | UUGGAUAUCGCCAGGAUGA | UCAuccuGGcGAuAuccAAUU | 1801 |
| R-008362899-000F | 2543 | 175 | GCCCAGGACCUCAUGGAUG | B GcccAGGAccucAuGGAuGTT B | 1802 |
| R-008362899-000F | 2543 | 175 | GCCCAGGACCUCAUGGAUG | CAUccAuGAGGuccuGGGcUU | 1803 |
| R-008362749-000J | 708 | 176 | AACUUGCCACACGUGCAAU | B AAcuuGccAcAcGuGcAAuTT B | 1804 |
| R-008362749-000J | 708 | 176 | AACUUGCCACACGUGCAAU | AUUGcAcGuGuGGcAAGuuUU | 1805 |
| R-008362845-000J | 447 | 177 | CCCAAGUCCUGUAUGAGUG | B cccAAGuccuGuAuGAGuGTT B | 1806 |
| R-008362845-000J | 447 | 177 | CCCAAGUCCUGUAUGAGUG | CAcucAuAcAGGAcuuGGGUU | 1807 |
| R-008362842-000H | 654 | 178 | CACAGAUGCUGAAACAUGC | GCAuGuuucAGcAucuGuGUU | 1809 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008362842-000H | 654 | 178 | CACAGAUGCUGAAACAUGC | B cAcAGAuGcuGAAAcAuGcTT B | 1808 |
| R-008362896-000E | 912 | 179 | CUGGGACCUUGCAUAACCU | B cuGGGAccuuGcAuAAccuTT B | 1810 |
| R-008362896-000E | 912 | 179 | CUGGGACCUUGCAUAACCU | AGGuuAuGcAAGGucccAGUU | 1811 |
| R-008363058-000U | 1009 | 180 | AGUGGAUUCUGUGUUGUUU | AAAcAAcAcAGAAuccAcuUU | 1813 |
| R-008363058-000U | 1009 | 180 | AGUGGAUUCUGUGUUGUUU | B AGuGGAuucuGuGuuGuuuTT B | 1812 |
| R-008362941-000J | 1354 | 181 | AAUGCAAGCUUUAGGACUU | B AAuGcAAGcuuuAGGAcuuTT B | 1814 |
| R-008362941-000J | 1354 | 181 | AAUGCAAGCUUUAGGACUU | AAGuccuAAAGcuuGcAuuUU | 1815 |
| R-008362839-000B | 1969 | 182 | AGAAAUAGUUGAAGGUUGU | B AGAAAuAGuuGAAGGuuGuTT B | 1816 |
| R-008362839-000B | 1969 | 182 | AGAAAUAGUUGAAGGUUGU | ACAAccuucAAcuAuuucuUU | 1817 |
| R-008363055-000T | 1959 | 183 | UCCGCAUGGAAGAAAUAGU | ACUAuuucuuccAuGcGGAUU | 1819 |
| R-008363055-000T | 1959 | 183 | UCCGCAUGGAAGAAAUAGU | B uccGcAuGGAAGAAAuAGuTT B | 1818 |
| R-008362836-000A | 557 | 184 | GCUAUGUUCCCUGAGACAU | B GcuAuGuucccuGAGAcAuTT B | 1820 |
| R-008362836-000A | 557 | 184 | GCUAUGUUCCCUGAGACAU | AUGucucAGGGAAcAuAGcUU | 1821 |
| R-008363052-000S | 403 | 185 | UCUGAGUGGUAAAGGCAAU | AUUGccuuuAccAcucAGAUU | 1823 |
| R-008363052-000S | 403 | 185 | UCUGAGUGGUAAAGGCAAU | B ucuGAGuGGuAAAGGcAAuTT B | 1822 |
| R-008363049-000K | 1356 | 186 | UGCAAGCUUUAGGACUUCA | B uGcAAGcuuuAGGAcuucATT B | 1824 |
| R-008363049-000K | 1356 | 186 | UGCAAGCUUUAGGACUUCA | UGAAGuccuAAAGcuuGcAUU | 1825 |
| R-008362893-000D | 517 | 187 | UGGACAGUAUGCAAUGACU | B uGGAcAGuAuGcAAuGAcuTT B | 1826 |
| R-008362893-000D | 517 | 187 | UGGACAGUAUGCAAUGACU | AGUcAuuGcAuAcuGuccAUU | 1827 |
| R-008362890-000C | 1238 | 188 | UUAGUAAAUAUAAUGAGGA | UCCucAuuAuAuuuAcuAAUU | 1829 |
| R-008362890-000C | 1238 | 188 | UUAGUAAAUAUAAUGAGGA | B uuAGuAAAuAuAAuGAGGATT B | 1828 |
| R-008362995-000F | 843 | 189 | CUCAGAUGGUGUCUGCUAU | B cucAGAuGGuGucuGcuAuTT B | 1830 |
| R-008362995-000F | 843 | 189 | CUCAGAUGGUGUCUGCUAU | AUAGcAGAcAccAucuGAGUU | 1831 |
| R-008362992-000E | 496 | 190 | AGAACAAGUAGCUGAUAUU | B AGAAcAAGuAGcuGAuAuuTT B | 1832 |
| R-008362992-000E | 496 | 190 | AGAACAAGUAGCUGAUAUU | AAUAucAGcuAcuuGuucuUU | 1833 |
| R-008363046-000J | 2387 | 191 | CUUGGAUAUCGCCAGGAUG | B cuuGGAuAucGccAGGAuGTT B | 1834 |
| R-008363046-000J | 2387 | 191 | CUUGGAUAUCGCCAGGAUG | CAUccuGGcGAuAuccAAGUU | 1835 |
| R-008362704-000W | 1660 | 192 | CAUCUGUGCUCUUCGUCAU | AUGAcGAAGAGcAcAGAuGUU | 1837 |
| R-008362704-000W | 1660 | 192 | CAUCUGUGCUCUUCGUCAU | B cAucuGuGcucuucGucAuTT B | 1836 |
| R-008362938-000C | 2497 | 193 | CCCUGGUGCUGACUAUCCA | B cccuGGuGcuGAcuAuccATT B | 1838 |
| R-008362938-000C | 2497 | 193 | CCCUGGUGCUGACUAUCCA | UGGAuAGucAGcAccAGGGUU | 1839 |
| R-008363043-000H | 1870 | 194 | ACGACUAGUUCAGUUGCUU | B AcGAcuAGuucAGuuGcuuTT B | 1840 |
| R-008363043-000H | 1870 | 194 | ACGACUAGUUCAGUUGCUU | AAGcAAcuGAAcuAGucGuUU | 1841 |
| R-008362746-000H | 2353 | 195 | UCUUGGACUUGAUAUUGGU | B ucuuGGAcuuGAuAuuGGuTT B | 1842 |
| R-008362746-000H | 2353 | 195 | UCUUGGACUUGAUAUUGGU | ACCAAuAucAAGuccAAGAUU | 1843 |
| R-008362743-000G | 2401 | 196 | GGAUGAUCCUAGCUAUCGU | B GGAuGAuccuAGcuAucGuTT B | 1844 |
| R-008362743-000G | 2401 | 196 | GGAUGAUCCUAGCUAUCGU | ACGAuAGcuAGGAucAuccUU | 1845 |
| R-008362887-000W | 1238 | 188 | UUAGUAAAUAUAAUGAGGA | B UUAGUAAAUAUAAUGAGGATT B | 1846 |
| R-008362887-000W | 1238 | 188 | UUAGUAAAUAUAAUGAGGA | UCCUCAUUAUAUUUACUAAUU | 1847 |
| R-008363040-000G | 2125 | 133 | UGAACUUGCUCAGGACAAG | B UGAACUUGCUCAGGACAAGTT B | 1848 |
| R-008363040-000G | 2125 | 133 | UGAACUUGCUCAGGACAAG | CUUGUCCUGAGCAAGUUCAUU | 1849 |
| R-008362935-000B | 843 | 189 | CUCAGAUGGUGUCUGCUAU | AUAGCAGACACCAUCUGAGUU | 1851 |
| R-008362935-000B | 843 | 189 | CUCAGAUGGUGUCUGCUAU | B CUCAGAUGGUGUCUGCUAUTT B | 1850 |
| R-008362740-000F | 496 | 190 | AGAACAAGUAGCUGAUAUU | AAUAUCAGCUACUUGUUCUUU | 1853 |
| R-008362740-000F | 496 | 190 | AGAACAAGUAGCUGAUAUU | B AGAACAAGUAGCUGAUAUUTT B | 1852 |
| R-008362884-000V | 2074 | 144 | GCUUUAUUCUCCCAUUGAA | UUCAAUGGGAGAAUAAAGCUU | 1855 |
| R-008362884-000V | 2074 | 144 | GCUUUAUUCUCCCAUUGAA | B GCUUUAUUCUCCCAUUGAATT B | 1854 |
| R-008362701-000V | 2503 | 134 | UGCUGACUAUCCAGUUGAU | B UGCUGACUAUCCAGUUGAUTT B | 1856 |
| R-008362701-000V | 2503 | 134 | UGCUGACUAUCCAGUUGAU | AUCAACUGGAUAGUCAGCAUU | 1857 |
| R-008362698-000C | 2387 | 191 | CUUGGAUAUCGCCAGGAUG | B CUUGGAUAUCGCCAGGAUGTT B | 1858 |
| R-008362698-000C | 2387 | 191 | CUUGGAUAUCGCCAGGAUG | CAUCCUGGCGAUAUCCAAGUU | 1859 |
| R-008362800-000W | 1660 | 192 | CAUCUGUGCUCUUCGUCAU | AUGACGAAGAGCACAGAUGUU | 1861 |
| R-008362800-000W | 1660 | 192 | CAUCUGUGCUCUUCGUCAU | B CAUCUGUGCUCUUCGUCAUTT B | 1860 |
| R-008362737-000Z | 2497 | 193 | CCCUGGUGCUGACUAUCCA | B CCCUGGUGCUGACUAUCCATT B | 1862 |
| R-008362737-000Z | 2497 | 193 | CCCUGGUGCUGACUAUCCA | UGGAUAGUCAGCACCAGGGUU | 1863 |
| R-008363037-000A | 1503 | 142 | AUGAUAUAAAUGUGGUCAC | B AUGAUAUAAAUGUGGUCACTT B | 1864 |
| R-008363037-000A | 1503 | 142 | AUGAUAUAAAUGUGGUCAC | GUGACCACAUUUAUAUCAUUU | 1865 |
| R-008362734-000Y | 2506 | 137 | UGACUAUCCAGUUGAUGGG | CCCAUCAACUGGAUAGUCAUU | 1867 |
| R-008362734-000Y | 2506 | 137 | UGACUAUCCAGUUGAUGGG | B UGACUAUCCAGUUGAUGGGTT B | 1866 |
| R-008362797-000D | 2052 | 71 | CCAUUCCAUUGUUUGUGCA | UGCACAAACAAUGGAAUGGUU | 1869 |
| R-008362797-000D | 2052 | 71 | CCAUUCCAUUGUUUGUGCA | B CCAUUCCAUUGUUUGUGCATT B | 1868 |
| R-008362731-000X | 2389 | 129 | UGGAUAUCGCCAGGAUGAU | B UGGAUAUCGCCAGGAUGAUTT B | 1870 |
| R-008362731-000X | 2389 | 129 | UGGAUAUCGCCAGGAUGAU | AUCAUCCUGGCGAUAUCCAUU | 1871 |
| R-008362794-000C | 1406 | 146 | AACUGUCUUUGGACUCUCA | B AACUGUCUUUGGACUCUCATT B | 1872 |
| R-008362794-000C | 1406 | 146 | AACUGUCUUUGGACUCUCA | UGAGAGUCCAAAGACAGUUUU | 1873 |
| R-008362833-000Z | 1796 | 12 | ACUGUUGGAUUGAUUCGAA | B ACUGUUGGAUUGAUUCGAATT B | 1874 |
| R-008362833-000Z | 1796 | 12 | ACUGUUGGAUUGAUUCGAA | UUCGAAUCAAUCCAACAGUUU | 1875 |
| R-008362989-000Y | 2505 | 139 | CUGACUAUCCAGUUGAUGG | B CUGACUAUCCAGUUGAUGGTT B | 1876 |
| R-008362989-000Y | 2505 | 139 | CUGACUAUCCAGUUGAUGG | CCAUCAACUGGAUAGUCAGUU | 1877 |
| R-008362791-000B | 1797 | 5 | CUGUUGGAUUGAUUCGAAA | B CUGUUGGAUUGAUUCGAAATT B | 1878 |
| R-008362791-000B | 1797 | 5 | CUGUUGGAUUGAUUCGAAA | UUUCGAAUCAAUCCAACAGUU | 1879 |
| R-008362881-000U | 643 | 75 | GGCUGAACCAUCACAGAUG | B GGCUGAACCAUCACAGAUGTT B | 1880 |
| R-008362881-000U | 643 | 75 | GGCUGAACCAUCACAGAUG | CAUCUGUGAUGGUUCAGCCUU | 1881 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008363034-000Z | 582 | 147 | AGGGCAUGCAGAUCCCAUC | GAUGGGAUCUGCAUGCCCUUU | 1883 |
| R-008363034-000Z | 582 | 147 | AGGGCAUGCAGAUCCCAUC | B AGGGCAUGCAGAUCCCAUCTT B | 1882 |
| R-008362830-000Y | 2502 | 136 | GUGCUGACUAUCCAGUUGA | B GUGCUGACUAUCCAGUUGATT B | 1884 |
| R-008362830-000Y | 2502 | 136 | GUGCUGACUAUCCAGUUGA | UCAACUGGAUAGUCAGCACUU | 1885 |
| R-008362827-000S | 1505 | 148 | GAUAUAAAUGUGGUCACCU | AGGUGACCACAUUUAUAUCUU | 1887 |
| R-008362827-000S | 1505 | 148 | GAUAUAAAUGUGGUCACCU | B GAUAUAAAUGUGGUCACCUTT B | 1886 |
| R-008362728-000R | 1432 | 149 | UUCAGAUGCUGCAACUAAA | B UUCAGAUGCUGCAACUAAATT B | 1888 |
| R-008362728-000R | 1432 | 149 | UUCAGAUGCUGCAACUAAA | UUUAGUUGCAGCAUCUGAAUU | 1889 |
| R-008362986-000X | 1968 | 150 | AAGAAAUAGUUGAAGGUUG | CAACCUUCAACUAUUUCUUUU | 1891 |
| R-008362986-000X | 1968 | 150 | AAGAAAUAGUUGAAGGUUG | B AAGAAAUAGUUGAAGGUUGTT B | 1890 |
| R-008362878-000M | 694 | 109 | UCAAGAUGAUGCAGAACUU | B UCAAGAUGAUGCAGAACUUTT B | 1892 |
| R-008362878-000M | 694 | 109 | UCAAGAUGAUGCAGAACUU | AAGUUCUGCAUCAUCUUGAUU | 1893 |
| R-008362824-000R | 2398 | 151 | CCAGGAUGAUCCUAGCUAU | AUAGCUAGGAUCAUCCUGGUU | 1895 |
| R-008362824-000R | 2398 | 151 | CCAGGAUGAUCCUAGCUAU | B CCAGGAUGAUCCUAGCUAUTT B | 1894 |
| R-008362932-000A | 2259 | 125 | AGGACAAGCCACAAGAUUA | UAAUCUUGUGGCUUGUCCUUU | 1897 |
| R-008362932-000A | 2259 | 125 | AGGACAAGCCACAAGAUUA | B AGGACAAGCCACAAGAUUATT B | 1896 |
| R-008362788-000V | 954 | 152 | UGGCCAUCUUUAAGUCUGG | B UGGCCAUCUUUAAGUCUGGTT B | 1898 |
| R-008362788-000V | 954 | 152 | UGGCCAUCUUUAAGUCUGG | CCAGACUUAAAGAUGGCCAUU | 1899 |
| R-008362983-000W | 2197 | 116 | ACUUCACUCUAGGAAUGAA | B ACUUCACUCUAGGAAUGAATT B | 1900 |
| R-008362983-000W | 2197 | 116 | ACUUCACUCUAGGAAUGAA | UUCAUUCCUAGAGUGAAGUUU | 1901 |
| R-008362929-000U | 505 | 153 | AGCUGAUAUUGAUGGACAG | B AGCUGAUAUUGAUGGACAGTT B | 1902 |
| R-008362929-000U | 505 | 153 | AGCUGAUAUUGAUGGACAG | CUGUCCAUCAAUAUCAGCUU | 1903 |
| R-008362926-000T | 2011 | 154 | UCGGGAUGUUCACAACCGA | B UCGGGAUGUUCACAACCGATT B | 1904 |
| R-008362926-000T | 2011 | 154 | UCGGGAUGUUCACAACCGA | UCGGUUGUGAACAUCCCGAUU | 1905 |
| R-008362923-000S | 1339 | 155 | UGUAGAAGCUGGUGGAAUG | B UGUAGAAGCUGGUGGAAUGTT B | 1906 |
| R-008362923-000S | 1339 | 155 | UGUAGAAGCUGGUGGAAUG | CAUUCCACCAGCUUCUACAUU | 1907 |
| R-008362695-000B | 1242 | 156 | UAAAUAUAAUGAGGACCUA | B UAAAUAUAAUGAGGACCUATT B | 1908 |
| R-008362695-000B | 1242 | 156 | UAAAUAUAAUGAGGACCUA | UAGGUCCUCAUUAUAUUUAUU | 1909 |
| R-008362692-000A | 499 | 107 | ACAAGUAGCUGAUAUUGAU | B ACAAGUAGCUGAUAUUGAUTT B | 1910 |
| R-008362692-000A | 499 | 107 | ACAAGUAGCUGAUAUUGAU | AUCAAUAUCAGCUACUUGUUU | 1911 |
| R-008362689-000U | 1870 | 194 | ACGCUAGUUCAGUUGCUU | AAGCAACUGAACUAGUCGUUU | 1913 |
| R-008362689-000U | 1870 | 194 | ACGCUAGUUCAGUUGCUU | B ACGCUAGUUCAGUUGCUUTT B | 1912 |
| R-008362785-000U | 2353 | 195 | UCUUGGACUUGAUAUUGGU | B UCUUGGACUUGAUAUUGGUTT B | 1914 |
| R-008362785-000U | 2353 | 195 | UCUUGGACUUGAUAUUGGU | ACCAAUAUCAAGUCCAAGAUU | 1915 |
| R-008363031-000Y | 2401 | 196 | GGAUGAUCCUAGCUAUCGU | ACGAUAGCUAGGAUCAUCCUU | 1917 |
| R-008363031-000Y | 2401 | 196 | GGAUGAUCCUAGCUAUCGU | B GGAUGAUCCUAGCUAUCGUTT B | 1916 |
| R-008362920-000R | 878 | 197 | AAUACAAAUGAUGUAGAAA | UUUCUACAUCAUUUGUAUUUU | 1919 |
| R-008362920-000R | 878 | 197 | AAUACAAAUGAUGUAGAAA | B AAUACAAAUGAUGUAGAAATT B | 1918 |
| R-008362917-000J | 2046 | 112 | UAAAUACCAUUCCAUUGUU | AACAUGGAAUGGUAUUUAUU | 1921 |
| R-008362917-000J | 2046 | 112 | UAAAUACCAUUCCAUUGUU | B UAAAUACCAUUCCAUUGUUTT B | 1920 |
| R-008362980-000V | 647 | 198 | GAACCAUCACAGAUGCUGA | UCAGCAUCUGUGAUGGUUCUU | 1923 |
| R-008362980-000V | 647 | 198 | GAACCAUCACAGAUGCUGA | B GAACCAUCACAGAUGCUGATT B | 1922 |
| R-008362725-000P | 1998 | 199 | UUCACAUCCUAGCUCGGGA | B UUCACAUCCUAGCUCGGGATT B | 1924 |
| R-008362725-000P | 1998 | 199 | UUCACAUCCUAGCUCGGGA | UCCCGAGCUAGGAUGUGAAUU | 1925 |
| R-008363028-000S | 588 | 200 | UGCAGAUCCCAUCUACACA | UGUGUAGAUGGGAUCUGCAUU | 1927 |
| R-008363028-000S | 588 | 200 | UGCAGAUCCCAUCUACACA | B UGCAGAUCCCAUCUACACATT B | 1926 |
| R-008362782-000T | 2042 | 201 | GGACUAAAUACCAUUCCAU | AUGGAAUGGUAUUUAGUCCUU | 1929 |
| R-008362782-000T | 2042 | 201 | GGACUAAAUACCAUUCCAU | B GGACUAAAUACCAUUCCAUTT B | 1928 |
| R-008362977-000N | 855 | 202 | CUGCUAUUGUACGUACCAU | B CUGCUAUUGUACGUACCAUTT B | 1930 |
| R-008362977-000N | 855 | 202 | CUGCUAUUGUACGUACCAU | AUGGUACGUACAAUAGCAGUU | 1931 |
| R-008362686-000T | 2038 | 203 | CAGAGGACUAAAUACCAUU | AAUGGUAUUUAGUCCUCUGUU | 1933 |
| R-008362686-000T | 2038 | 203 | CAGAGGACUAAAUACCAUU | B CAGAGGACUAAAUACCAUUTT B | 1932 |
| R-008362875-000L | 1786 | 204 | GAUAAAGGCUACUGUUGGA | UCCAACAGUAGCCUUUAUCUU | 1935 |
| R-008362875-000L | 1786 | 204 | GAUAAAGGCUACUGUUGGA | B GAUAAAGGCUACUGUUGGATT B | 1934 |
| R-008363025-000R | 1501 | 205 | AGAUGAUAUAAAUGUGGUC | B AGAUGAUAUAAAUGUGGUCTT B | 1936 |
| R-008363025-000R | 1501 | 205 | AGAUGAUAUAAAUGUGGUC | GACCACAUUUAUAUCAUCUUU | 1937 |
| R-008362914-000H | 1834 | 206 | AAAUCAUGCACCUUUGCGU | ACGCAAAGGUGCAUGAUUUUU | 1939 |
| R-008362914-000H | 1834 | 206 | AAAUCAUGCACCUUUGCGU | B AAAUCAUGCACCUUUGCGUTT B | 1938 |
| R-008362872-000K | 1157 | 207 | ACGACAGACUGCCUUCAAA | B ACGACAGACUGCCUUCAAATT B | 1940 |
| R-008362872-000K | 1157 | 207 | ACGACAGACUGCCUUCAAA | UUUGAAGGCAGUCUGUCGUUU | 1941 |
| R-008362974-000M | 1239 | 208 | UAGUAAAUAUAAUGAGGAC | B UAGUAAAUAUAAUGAGGACTT B | 1942 |
| R-008362974-000M | 1239 | 208 | UAGUAAAUAUAAUGAGGAC | GUCCUCAUUAUAUUUACUAUU | 1943 |
| R-008362821-000P | 1248 | 209 | UAAUGAGGACCUAUACUUA | B UAAUGAGGACCUAUACUUATT B | 1944 |
| R-008362821-000P | 1248 | 209 | UAAUGAGGACCUAUACUUA | UAAGUAUAGGUCCUCAUUAUU | 1945 |
| R-008362683-000S | 660 | 210 | UGCUGAAACAUGCAGUUGU | B UGCUGAAACAUGCAGUUGUTT B | 1946 |
| R-008362683-000S | 660 | 210 | UGCUGAAACAUGCAGUUGU | ACAACUGCAUGUUUCAGCAUU | 1947 |
| R-008363022-000P | 285 | 211 | AUUUGAUGGAGUUGGACAU | B AUUUGAUGGAGUUGGACAUTT B | 1948 |
| R-008363022-000P | 285 | 211 | AUUUGAUGGAGUUGGACAU | AUGUCCAACUCCAUCAAAUUU | 1949 |
| R-008362779-000L | 1582 | 212 | CUGCCAAGUGGGUGGUAUA | B CUGCCAAGUGGGUGGUAUATT B | 1950 |
| R-008362779-000L | 1582 | 212 | CUGCCAAGUGGGUGGUAUA | UAUACCACCCACUUGGCAGUU | 1951 |
| R-008363019-000H | 1735 | 213 | UGGACUACCAGUUGUGGUU | AACCACAACUGGUAGUCCAUU | 1953 |
| R-008363019-000H | 1735 | 213 | UGGACUACCAGUUGUGGUU | B UGGACUACCAGUUGUGGUUTT B | 1952 |
| R-008362776-000K | 771 | 214 | UUAAUAAGGCUGCAGUUAU | AUAACUGCAGCCUUAUUAAUU | 1955 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008362776-000K | 771 | 214 | UUAAUAAGGCUGCAGUUAU | B UUAAUAAGGCUGCAGUUAUTT B | 1954 |
| R-008363016-000G | 1060 | 215 | ACAUCAAGAAGGAGCUAAA | B ACAUCAAGAAGGAGCUAAATT B | 1956 |
| R-008363016-000G | 1060 | 215 | ACAUCAAGAAGGAGCUAAA | UUUAGCUCCUUCUUGAUGUUU | 1957 |
| R-008362773-000J | 2390 | 216 | GGAUAUCGCCAGGAUGAUC | GAUCAUCCUGGCGAUAUCCUU | 1959 |
| R-008362773-000J | 2390 | 216 | GGAUAUCGCCAGGAUGAUC | B GGAUAUCGCCAGGAUGAUCTT B | 1958 |
| R-008362971-000L | 2509 | 81 | CUAUCCAGUUGAUGGGCUG | CAGCCCAUCAACUGGAUAGUU | 1961 |
| R-008362971-000L | 2509 | 81 | CUAUCCAGUUGAUGGGCUG | B CUAUCCAGUUGAUGGGCUGTT B | 1960 |
| R-008362722-000N | 2186 | 217 | CUGACAGAGUUACUUCACU | B CUGACAGAGUUACUUCACUTT B | 1962 |
| R-008362722-000N | 2186 | 217 | CUGACAGAGUUACUUCACU | AGUGAAGUAACUCUGUCAGUU | 1963 |
| R-008363013-000F | 1632 | 218 | GUGACAGGGAAGACAUCAC | B GUGACAGGGAAGACAUCACTT B | 1964 |
| R-008363013-000F | 1632 | 218 | GUGACAGGGAAGACAUCAC | GUGAUGUCUUCCCUGUCACUU | 1965 |
| R-008362818-000H | 619 | 219 | UCAUCCCACUAAUGUCCAG | CUGGACAUUAGUGGGAUGAUU | 1967 |
| R-008362818-000H | 619 | 219 | UCAUCCCACUAAUGUCCAG | B UCAUCCCACUAAUGUCCAGTT B | 1966 |
| R-008362968-000E | 1656 | 220 | CUGCCAUCUGUGCUCUUCG | B CUGCCAUCUGUGCUCUUCGTT B | 1968 |
| R-008362968-000E | 1656 | 220 | CUGCCAUCUGUGCUCUUCG | CGAAGAGCACAGAUGGCAGUU | 1969 |
| R-008362815-000G | 1506 | 221 | AUAUAAAUGUGGUCACCUG | B AUAUAAAUGUGGUCACCUGTT B | 1970 |
| R-008362815-000G | 1506 | 221 | AUAUAAAUGUGGUCACCUG | CAGGUGACCACAUUUAUAUUU | 1971 |
| R-008362869-000D | 2501 | 76 | GGUGCUGACUAUCCAGUUG | B GGUGCUGACUAUCCAGUUGTT B | 1972 |
| R-008362869-000D | 2501 | 76 | GGUGCUGACUAUCCAGUUG | CAACUGGAUAGUCAGCACCUU | 1973 |
| R-008362719-000G | 2494 | 222 | CCACCCUGGUGCUGACUAU | AUAGUCAGCACCAGGGUGGUU | 1975 |
| R-008362719-000G | 2494 | 222 | CCACCCUGGUGCUGACUAU | B CCACCCUGGUGCUGACUAUTT B | 1974 |
| R-008362770-000H | 1666 | 223 | UGCUCUUCGUCAUCUGACC | GGUCAGAUGACGAAGAGCAUU | 1977 |
| R-008362770-000H | 1666 | 223 | UGCUCUUCGUCAUCUGACC | B UGCUCUUCGUCAUCUGACCTT B | 1976 |
| R-008362680-000R | 1635 | 224 | ACAGGGAAGACAUCACUGA | B ACAGGGAAGACAUCACUGATT B | 1978 |
| R-008362680-000R | 1635 | 224 | ACAGGGAAGACAUCACUGA | UCAGUGAUGUCUUCCCUGUUU | 1979 |
| R-008362866-000C | 294 | 225 | AGUUGGACAUGGCCAUGGA | UCCAUGGCCAUGUCCAACUUU | 1981 |
| R-008362866-000C | 294 | 225 | AGUUGGACAUGGCCAUGGA | B AGUUGGACAUGGCCAUGGATT B | 1980 |
| R-008362863-000B | 641 | 226 | UUGGCUGAACCAUCACAGA | B UUGGCUGAACCAUCACAGATT B | 1982 |
| R-008362863-000B | 641 | 226 | UUGGCUGAACCAUCACAGA | UCUGUGAUGGUUCAGCCAAUU | 1983 |
| R-008362965-000D | 576 | 227 | UAGAUGAGGGCAUGCAGAU | AUCUGCAUGCCCUCAUCUAUU | 1985 |
| R-008362965-000D | 576 | 227 | UAGAUGAGGGCAUGCAGAU | B UAGAUGAGGGCAUGCAGAUTT B | 1984 |
| R-008362911-000G | 577 | 228 | AGAUGAGGGCAUGCAGAUC | B AGAUGAGGGCAUGCAGAUCTT B | 1986 |
| R-008362911-000G | 577 | 228 | AGAUGAGGGCAUGCAGAUC | GAUCUGCAUGCCCUCAUCUUU | 1987 |
| R-008362767-000B | 1661 | 229 | AUCUGUGCUCUUCGUCAUC | GAUGACGAAGAGCACAGAUUU | 1989 |
| R-008362767-000B | 1661 | 229 | AUCUGUGCUCUUCGUCAUC | B AUCUGUGCUCUUCGUCAUCTT B | 1988 |
| R-008362962-000C | 707 | 230 | GAACUUGCCACACGUGCAA | B GAACUUGCCACACGUGCAATT B | 1990 |
| R-008362962-000C | 707 | 230 | GAACUUGCCACACGUGCAA | UUGCACGUGUGGCAAGUUCUU | 1991 |
| R-008362677-000J | 1659 | 231 | CCAUCUGUGCUCUUCGUCA | B CCAUCUGUGCUCUUCGUCATT B | 1992 |
| R-008362677-000J | 1659 | 231 | CCAUCUGUGCUCUUCGUCA | UGACGAAGAGCACAGAUGGUU | 1993 |
| R-008362674-000H | 1547 | 88 | CUCACUUGCAAUAAUUAUA | UAUAAUUAUUGCAAGUGAGUU | 1995 |
| R-008362674-000H | 1547 | 88 | CUCACUUGCAAUAAUUAUA | B CUCACUUGCAAUAAUUAUATT B | 1994 |
| R-008362959-000W | 867 | 90 | GUACCAUGCAGAAUACAAA | UUUGUAUUCUGCAUGGUACUU | 1997 |
| R-008362959-000W | 867 | 90 | GUACCAUGCAGAAUACAAA | B GUACCAUGCAGAAUACAAATT B | 1996 |
| R-008362956-000V | 1185 | 232 | AUGGCAACCAAGAAAGCAA | UUGCUUUCUUGGUUGCCAUUU | 1999 |
| R-008362956-000V | 1185 | 232 | AUGGCAACCAAGAAAGCAA | B AUGGCAACCAAGAAAGCAATT B | 1998 |
| R-008362764-000A | 664 | 233 | GAAACAUGCAGUUGUAAAC | GUUUACAACUGCAUGUUUCUU | 2001 |
| R-008362764-000A | 664 | 233 | GAAACAUGCAGUUGUAAAC | B GAAACAUGCAGUUGUAAACTT B | 2000 |
| R-008362716-000F | 820 | 18 | CAGACACGCUAUCAUGCGU | B CAGACACGCUAUCAUGCGUTT B | 2002 |
| R-008362716-000F | 820 | 18 | CAGACACGCUAUCAUGCGU | ACGCAUGAUAGCGUGUCUGUU | 2003 |
| R-008362812-000F | 2266 | 101 | GCCACAAGAUUACAAGAAA | UUUCUUGUAAUCUUGUGGCUU | 2005 |
| R-008362812-000F | 2266 | 101 | GCCACAAGAUUACAAGAAA | B GCCACAAGAUUACAAGAAATT B | 2004 |
| R-008362671-000G | 1749 | 234 | UGGUUAAGCUCUUACACCC | GGGUGUAAGAGCUUAACCAUU | 2007 |
| R-008362671-000G | 1749 | 234 | UGGUUAAGCUCUUACACCC | B UGGUUAAGCUCUUACACCCTT B | 2006 |
| R-008362953-000U | 1234 | 235 | AGCUUUAGUAAAUAUAAUG | B AGCUUUAGUAAAUAUAAUGTT B | 2008 |
| R-008362953-000U | 1234 | 235 | AGCUUUAGUAAAUAUAAUG | CAUUAUAUUUACUAAAGCUUU | 2009 |
| R-008362950-000T | 691 | 236 | CUAUCAAGAUGAUGCAGAA | B CUAUCAAGAUGAUGCAGAATT B | 2010 |
| R-008362950-000T | 691 | 236 | CUAUCAAGAUGAUGCAGAA | UUCUGCAUCAUCUUGAUAGUU | 2011 |
| R-008363010-000E | 1387 | 237 | AAGUCAACGUCUUGUUCAG | B AAGUCAACGUCUUGUUCAGTT B | 2012 |
| R-008363010-000E | 1387 | 237 | AAGUCAACGUCUUGUUCAG | CUGAACAAGACGUUGACUUUU | 2013 |
| R-008381224-000R | 1797 | 5 | CUGUUGGAUUGAUUCGAAA | UUUCGAAUCAAUCCAACAGUsU | 2015 |
| R-008381224-000R | 1797 | 5 | CUGUUGGAUUGAUUCGAAA | B CUGUUGGAUUGAUUCGAAAUsU B | 2014 |
| R-008381211-000X | 1797 | 5 | CUGUUGGAUUGAUUCGAAA | B cuGuuGGAuuGAuucGAAAUsU B | 2017 |
| R-008381211-000X | 1797 | 5 | CUGUUGGAUUGAUUCGAAA | uuucGAAucAAuccAAcAGUsU | 2016 |
| R-008381038-000Y | 1797 | 5 | CUGUUGGAUUGAUUCGAAA | UUUcGAAucAAuccAAcAGUsU | 2019 |
| R-008381038-000Y | 1797 | 5 | CUGUUGGAUUGAUUCGAAA | B cuGuuGGAuuGAuucGAAAUsU B | 2018 |
| R-008381052-000F | 1797 | 5 | CUGUUGGAUUGAUUCGAAA | uuucGAAucAAuccAAcAGUsU | 2016 |
| R-008381052-000F | 1797 | 5 | CUGUUGGAUUGAUUCGAAA | B CUGUUGGAUUGAUUCGAAAUsU B | 2020 |
| R-008381158-000T | 1797 | 5 | CUGUUGGAUUGAUUCGAAA | uuucGAAucAAuccAAcAGUsU | 2016 |
| R-008381158-000T | 1797 | 5 | CUGUUGGAUUGAUUCGAAA | B CUGUUGGAUUGAUUCGAAAUsU B | 2021 |
| R-008381341-000J | 1797 | 5 | CUGUUGGAUUGAUUCGAAA | uuucGAAucAAuccAAcAGUsU | 2016 |
| R-008381341-000J | 1797 | 5 | CUGUUGGAUUGAUUCGAAA | B cuGuuGGAuuGAuucGAAAUsU B | 2022 |
| R-008381109-000P | 1797 | 5 | CUGUUGGAUUGAUUCGAAA | B CUGUUGGAUUGAUUCGAAAUsU B | 2020 |
| R-008381109-000P | 1797 | 5 | CUGUUGGAUUGAUUCGAAA | UUUCgaaUCaaUCCaacCagUsU | 2023 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008380818-000X | 1797 | 5 | CUGUUGGAUUGAUUCGAAA | B CUGUUGGAUUGAUUCGAAAUsU B | 2021 |
| R-008380818-000X | 1797 | 5 | CUGUUGGAUUGAUUCGAAA | UUUCgaaUCaaUCCaaCagUsU | 2023 |
| R-008381199-000W | 1797 | 5 | CUGUUGGAUUGAUUCGAAA | UUUCgaaUCaaUCCaaCagUsU | 2023 |
| R-008381199-000W | 1797 | 5 | CUGUUGGAUUGAUUCGAAA | B cuGuuGGAuuGAuucGAAAUsU B | 2022 |
| R-008381296-000E | 1797 | 5 | CUGUUGGAUUGAUUCGAAA | UUUCGAAUCAAUCCAACAGUsU | 2024 |
| R-008381296-000E | 1797 | 5 | CUGUUGGAUUGAUUCGAAA | B CUGUUGGAUUGAUUCGAAAUsU B | 2020 |
| R-008381042-000N | 1797 | 5 | CUGUUGGAUUGAUUCGAAA | UUUCGAAUCAAUCCAACAGUsU | 2024 |
| R-008381042-000N | 1797 | 5 | CUGUUGGAUUGAUUCGAAA | B CUGUUGGAUUGAUUCGAAAUsU B | 2021 |
| R-008380923-000F | 1797 | 5 | CUGUUGGAUUGAUUCGAAA | B cuGuuGGAuuGAuucGAAAUsU B | 2022 |
| R-008380923-000F | 1797 | 5 | CUGUUGGAUUGAUUCGAAA | UUUCGAAUCAAUCCAACAGUsU | 2024 |
| R-008381104-000W | 1797 | 5 | CUGUUGGAUUGAUUCGAAA | UUUCGAAUCAAUCCAACAGUsU | 2025 |
| R-008381104-000W | 1797 | 5 | CUGUUGGAUUGAUUCGAAA | B CUGUUGGAUUGAUUCGAAAUsU B | 2020 |
| R-008381098-000C | 1797 | 5 | CUGUUGGAUUGAUUCGAAA | UUUCGAAUCAAUCCAACAGUsU | 2025 |
| R-008381098-000C | 1797 | 5 | CUGUUGGAUUGAUUCGAAA | B CUGUUGGAUUGAUUCGAAAUsU B | 2021 |
| R-008380916-000P | 1797 | 5 | CUGUUGGAUUGAUUCGAAA | B cuGuuGGAuuGAuucGAAAUsU B | 2022 |
| R-008380916-000P | 1797 | 5 | CUGUUGGAUUGAUUCGAAA | UUUCGAAUCAAUCCAACAGUsU | 2025 |
| R-008380906-000X | 1797 | 5 | CUGUUGGAUUGAUUCGAAA | B CUGUUGGAUUGAUUCGAAAUsU B | 2020 |
| R-008380906-000X | 1797 | 5 | CUGUUGGAUUGAUUCGAAA | UUUcGAAucAAuccAAcAGUsU | 2019 |
| R-008381291-000L | 1797 | 5 | CUGUUGGAUUGAUUCGAAA | UUUcGAAucAAuccAAcAGUsU | 2019 |
| R-008381291-000L | 1797 | 5 | CUGUUGGAUUGAUUCGAAA | B CUGUUGGAUUGAUUCGAAAUsU B | 2021 |
| R-008381334-000T | 1797 | 5 | CUGUUGGAUUGAUUCGAAA | UUUcGAAucAAuccAAcAGUsU | 2019 |
| R-008381334-000T | 1797 | 5 | CUGUUGGAUUGAUUCGAAA | B cuGuuGGAuuGAuucGAAAUsU B | 2022 |
| R-008381330-000H | 1797 | 5 | CUGUUGGAUUGAUUCGAAA | B CUGUUGGAUUGAUUCGAAAUsU B | 2020 |
| R-008381330-000H | 1797 | 5 | CUGUUGGAUUGAUUCGAAA | UUUCgaaUCaaUCCaaCagUsU | 2026 |
| R-008381036-000F | 1797 | 5 | CUGUUGGAUUGAUUCGAAA | UUUCgaaUCaaUCCaaCagUsU | 2026 |
| R-008381036-000F | 1797 | 5 | CUGUUGGAUUGAUUCGAAA | B CUGUUGGAUUGAUUCGAAAUsU B | 2021 |
| R-008381287-000W | 1797 | 5 | CUGUUGGAUUGAUUCGAAA | B cuGuuGGAuuGAuucGAAAUsU B | 2022 |
| R-008381287-000W | 1797 | 5 | CUGUUGGAUUGAUUCGAAA | UUUCgaaUCaaUCCaaCagUsU | 2026 |
| R-008381027-000X | 2398 | 151 | CCAGGAUGAUCCUAGCUAU | B CCAGGAUGAUCCUAGCUAUUsU B | 2027 |
| R-008381027-000X | 2398 | 151 | CCAGGAUGAUCCUAGCUAU | AUAGCUAGGAUCAUCCUGGUsU | 2028 |
| R-008380896-000U | 2398 | 151 | CCAGGAUGAUCCUAGCUAU | B ccAGGAuGAuccuAGcuAuUsU B | 2029 |
| R-008380896-000U | 2398 | 151 | CCAGGAUGAUCCUAGCUAU | AuAGcuAGGAucAuccuGGUsU | 2030 |
| R-008381153-000Z | 2398 | 151 | CCAGGAUGAUCCUAGCUAU | AUAGcuAGGAucAuccuGGUsU | 2032 |
| R-008381153-000Z | 2398 | 151 | CCAGGAUGAUCCUAGCUAU | B ccAGGAuGAuccuAGcuAuUsU B | 2031 |
| R-008381323-000S | 2398 | 151 | CCAGGAUGAUCCUAGCUAU | AuAGcuAGGAucAuccuGGUsU | 2030 |
| R-008381323-000S | 2398 | 151 | CCAGGAUGAUCCUAGCUAU | B CCAGGAUGAUCCUAGCUAUUsU B | 2033 |
| R-008381315-000S | 2398 | 151 | CCAGGAUGAUCCUAGCUAU | AuAGcuAGGAucAuccuGGUsU | 2030 |
| R-008381315-000S | 2398 | 151 | CCAGGAUGAUCCUAGCUAU | B CCAGGAUGAUCCUAGCUAUUsU B | 2034 |
| R-008380888-000U | 2398 | 151 | CCAGGAUGAUCCUAGCUAU | AuAGcuAGGAucAuccuGGUsU | 2030 |
| R-008380888-000U | 2398 | 151 | CCAGGAUGAUCCUAGCUAU | B ccAGGAuGAuccuAGcuAuUsU B | 2035 |
| R-008381013-000V | 2398 | 151 | CCAGGAUGAUCCUAGCUAU | B CCAGGAUGAUCCUAGCUAUUsU B | 2033 |
| R-008381013-000V | 2398 | 151 | CCAGGAUGAUCCUAGCUAU | AUAgCUaggaUCaUCCUggUsU | 2036 |
| R-008381007-000M | 2398 | 151 | CCAGGAUGAUCCUAGCUAU | AUAgCUaggaUCaUCCUggUsU | 2036 |
| R-008381007-000M | 2398 | 151 | CCAGGAUGAUCCUAGCUAU | B CCAGGAUGAUCCUAGCUAUUsU B | 2034 |
| R-008380995-000V | 2398 | 151 | CCAGGAUGAUCCUAGCUAU | B ccAGGAuGAuccuAGcuAuUsU B | 2035 |
| R-008380995-000V | 2398 | 151 | CCAGGAUGAUCCUAGCUAU | AUAgCUaggaUCaUCCUggUsU | 2036 |
| R-008380878-000B | 2398 | 151 | CCAGGAUGAUCCUAGCUAU | AUAGCUAGGAUCAUCCUGGUsU | 2037 |
| R-008380878-000B | 2398 | 151 | CCAGGAUGAUCCUAGCUAU | B CCAGGAUGAUCCUAGCUAUUsU B | 2033 |
| R-008381143-000G | 2398 | 151 | CCAGGAUGAUCCUAGCUAU | AUAGCUAGGAUCAUCCUGGUsU | 2037 |
| R-008381143-000G | 2398 | 151 | CCAGGAUGAUCCUAGCUAU | B CCAGGAUGAUCCUAGCUAUUsU B | 2034 |
| R-008381282-000C | 2398 | 151 | CCAGGAUGAUCCUAGCUAU | B ccAGGAuGAuccuAGcuAuUsU B | 2035 |
| R-008381282-000C | 2398 | 151 | CCAGGAUGAUCCUAGCUAU | AUAGCUAGGAUCAUCCUGGUsU | 2037 |
| R-008380985-000C | 2398 | 151 | CCAGGAUGAUCCUAGCUAU | AUAGCUAGGAUCAUCCUGGUsU | 2038 |
| R-008380985-000C | 2398 | 151 | CCAGGAUGAUCCUAGCUAU | B CCAGGAUGAUCCUAGCUAUUsU B | 2033 |
| R-008381278-000M | 2398 | 151 | CCAGGAUGAUCCUAGCUAU | AUAGCUAGGAUCAUCCUGGUsU | 2038 |
| R-008381278-000M | 2398 | 151 | CCAGGAUGAUCCUAGCUAU | B CCAGGAUGAUCCUAGCUAUUsU B | 2034 |
| R-008381139-000S | 2398 | 151 | CCAGGAUGAUCCUAGCUAU | AUAGCUAGGAUCAUCCUGGUsU | 2038 |
| R-008381139-000S | 2398 | 151 | CCAGGAUGAUCCUAGCUAU | B ccAGGAuGAuccuAGcuAuUsU B | 2035 |
| R-008380871-000R | 2398 | 151 | CCAGGAUGAUCCUAGCUAU | AUAGcuAGGAucAuccuGGUsU | 2032 |
| R-008380871-000R | 2398 | 151 | CCAGGAUGAUCCUAGCUAU | B CCAGGAUGAUCCUAGCUAUUsU B | 2033 |
| R-008381272-000K | 2398 | 151 | CCAGGAUGAUCCUAGCUAU | AUAGcuAGGAucAuccuGGUsU | 2032 |
| R-008381272-000K | 2398 | 151 | CCAGGAUGAUCCUAGCUAU | B CCAGGAUGAUCCUAGCUAUUsU B | 2034 |
| R-008381268-000V | 2398 | 151 | CCAGGAUGAUCCUAGCUAU | AUAGcuAGGAucAuccuGGUsU | 2032 |
| R-008381268-000V | 2398 | 151 | CCAGGAUGAUCCUAGCUAU | B ccAGGAuGAuccuAGcuAuUsU B | 2035 |
| R-008381133-000P | 2398 | 151 | CCAGGAUGAUCCUAGCUAU | AUAgCUaggaUCaUCCUggUsU | 2039 |
| R-008381133-000P | 2398 | 151 | CCAGGAUGAUCCUAGCUAU | B CCAGGAUGAUCCUAGCUAUUsU B | 2033 |
| R-008381261-000J | 2398 | 151 | CCAGGAUGAUCCUAGCUAU | AUAgCUaggaUCaUCCUggUsU | 2039 |
| R-008381261-000J | 2398 | 151 | CCAGGAUGAUCCUAGCUAU | B CCAGGAUGAUCCUAGCUAUUsU B | 2034 |
| R-008381091-000S | 2398 | 151 | CCAGGAUGAUCCUAGCUAU | B ccAGGAuGAuccuAGcuAuUsU B | 2035 |
| R-008381091-000S | 2398 | 151 | CCAGGAUGAUCCUAGCUAU | AUAgCUaggaUCaUCCUggUsU | 2039 |
| R-008380861-000Y | 1870 | 194 | ACGACUAGUUCAGUUGCUU | AAGCAACUGAACUAGUCGUUsU | 2041 |
| R-008380861-000Y | 1870 | 194 | ACGACUAGUUCAGUUGCUU | B ACGACUAGUUCAGUUGCUUUsU B | 2040 |
| R-008380853-000Y | 1870 | 194 | ACGACUAGUUCAGUUGCUU | AAGcAAcuGAAcuAGucGuUsU | 2043 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008380853-000Y | 1870 | 194 | ACGACUAGUUCAGUUGCUU | B AcGAcuAGuucAGuuGcuuUsU B | 2042 |
| R-008380811-000L | 1870 | 194 | ACGACUAGUUCAGUUGCUU | B AcGAcuAGuucAGuuGcuuUsU B | 2044 |
| R-008380811-000L | 1870 | 194 | ACGACUAGUUCAGUUGCUU | AAGcAAcuGAAcuAGucGuUsU | 2045 |
| R-008380974-000B | 1870 | 194 | ACGACUAGUUCAGUUGCUU | AAGcAAcuGAAcuAGucGuUsU | 2043 |
| R-008380974-000B | 1870 | 194 | ACGACUAGUUCAGUUGCUU | B ACGACUAGUUCAGUUGCUUUsU B | 2046 |
| R-008380966-000B | 1870 | 194 | ACGACUAGUUCAGUUGCUU | AAGcAAcuGAAcuAGucGuUsU | 2043 |
| R-008380966-000B | 1870 | 194 | ACGACUAGUUCAGUUGCUU | B ACGACUAGUUCAGUUGCUUUsU B | 2047 |
| R-008381310-000Y | 1870 | 194 | ACGACUAGUUCAGUUGCUU | AAGcAAcuGAAcuAGucGuUsU | 2043 |
| R-008381310-000Y | 1870 | 194 | ACGACUAGUUCAGUUGCUU | B AcGAcuAGuucAGuuGcuuUsU B | 2048 |
| R-008381194-000C | 1870 | 194 | ACGACUAGUUCAGUUGCUU | B ACGACUAGUUCAGUUGCUUUsU B | 2046 |
| R-008381194-000C | 1870 | 194 | ACGACUAGUUCAGUUGCUU | AAGCaaCUgaaCUagUCgUUsU | 2049 |
| R-008380833-000N | 1870 | 194 | ACGACUAGUUCAGUUGCUU | B ACGACUAGUUCAGUUGCUUUsU B | 2047 |
| R-008380833-000N | 1870 | 194 | ACGACUAGUUCAGUUGCUU | AAGCaaCUgaaCUagUCgUUsU | 2049 |
| R-008381115-000X | 1870 | 194 | ACGACUAGUUCAGUUGCUU | AAGCaaCUgaaCUagUCgUUsU | 2049 |
| R-008381115-000X | 1870 | 194 | ACGACUAGUUCAGUUGCUU | B AcGAcuAGuucAGuuGcuuUsU B | 2048 |
| R-008381242-000H | 1870 | 194 | ACGACUAGUUCAGUUGCUU | AAGCAACUGAACUAGUCGUUsU | 2050 |
| R-008381242-000H | 1870 | 194 | ACGACUAGUUCAGUUGCUU | B ACGACUAGUUCAGUUGCUUUsU B | 2046 |
| R-008381235-000S | 1870 | 194 | ACGACUAGUUCAGUUGCUU | B ACGACUAGUUCAGUUGCUUUsU B | 2047 |
| R-008381235-000S | 1870 | 194 | ACGACUAGUUCAGUUGCUU | AAGCAACUGAACUAGUCGUUsU | 2050 |
| R-008381231-000G | 1870 | 194 | ACGACUAGUUCAGUUGCUU | AAGCAACUGAACUAGUCGUUsU | 2050 |
| R-008381231-000G | 1870 | 194 | ACGACUAGUUCAGUUGCUU | B AcGAcuAGuucAGuuGcuuUsU B | 2048 |
| R-008381304-000R | 1870 | 194 | ACGACUAGUUCAGUUGCUU | AAGCAACUGAACUAGUCGUUsU | 2051 |
| R-008381304-000R | 1870 | 194 | ACGACUAGUUCAGUUGCUU | B ACGACUAGUUCAGUUGCUUUsU B | 2046 |
| R-008380828-000P | 1870 | 194 | ACGACUAGUUCAGUUGCUU | B ACGACUAGUUCAGUUGCUUUsU B | 2047 |
| R-008380828-000P | 1870 | 194 | ACGACUAGUUCAGUUGCUU | AAGCAACUGAACUAGUCGUUsU | 2051 |
| R-008380926-000G | 1870 | 194 | ACGACUAGUUCAGUUGCUU | AAGCAACUGAACUAGUCGUUsU | 2051 |
| R-008380926-000G | 1870 | 194 | ACGACUAGUUCAGUUGCUU | B AcGAcuAGuucAGuuGcuuUsU B | 2048 |
| R-008381350-000T | 1870 | 194 | ACGACUAGUUCAGUUGCUU | AAGcAAcuGAAcuAGucGuUsU | 2045 |
| R-008381350-000T | 1870 | 194 | ACGACUAGUUCAGUUGCUU | B ACGACUAGUUCAGUUGCUUUsU B | 2046 |
| R-008381162-000H | 1870 | 194 | ACGACUAGUUCAGUUGCUU | B ACGACUAGUUCAGUUGCUUUsU B | 2047 |
| R-008381162-000H | 1870 | 194 | ACGACUAGUUCAGUUGCUU | AAGcAAcuGAAcuAGucGuUsU | 2045 |
| R-008380823-000W | 1870 | 194 | ACGACUAGUUCAGUUGCUU | AAGcAAcuGAAcuAGucGuUsU | 2045 |
| R-008380823-000W | 1870 | 194 | ACGACUAGUUCAGUUGCUU | B AcGAcuAGuucAGuuGcuuUsU B | 2048 |
| R-008381068-000A | 1870 | 194 | ACGACUAGUUCAGUUGCUU | AAGCaaCUgaaCUagUCgUUsU | 2052 |
| R-008381068-000A | 1870 | 194 | ACGACUAGUUCAGUUGCUU | B ACGACUAGUUCAGUUGCUUUsU B | 2046 |
| R-008381190-000T | 1870 | 194 | ACGACUAGUUCAGUUGCUU | AAGCaaCUgaaCUagUCgUUsU | 2052 |
| R-008381190-000T | 1870 | 194 | ACGACUAGUUCAGUUGCUU | B ACGACUAGUUCAGUUGCUUUsU B | 2047 |
| R-008380959-000K | 1870 | 194 | ACGACUAGUUCAGUUGCUU | AAGCaaCUgaaCUagUCgUUsU | 2052 |
| R-008380959-000K | 1870 | 194 | ACGACUAGUUCAGUUGCUU | B AcGAcuAGuucAGuuGcuuUsU B | 2048 |
| R-008381084-000A | 2401 | 196 | GGAUGAUCCUAGCUAUCGU | ACGAUAGCUAGGAUCAUCCUsU | 2054 |
| R-008381084-000A | 2401 | 196 | GGAUGAUCCUAGCUAUCGU | B GGAUGAUCCUAGCUAUCGUUsU B | 2053 |
| R-008380848-000Z | 2401 | 196 | GGAUGAUCCUAGCUAUCGU | B GGAuGAuccuAGcuAucGuUsU B | 2055 |
| R-008380848-000Z | 2401 | 196 | GGAUGAUCCUAGCUAUCGU | AcGAuAGcuAGGAucAuccUsU | 2056 |
| R-008380807-000W | 2401 | 196 | GGAUGAUCCUAGCUAUCGU | B GGAuGAuccuAGcuAucGuUsU B | 2057 |
| R-008380807-000W | 2401 | 196 | GGAUGAUCCUAGCUAUCGU | ACGAuAGcuAGGAucAuccUsU | 2058 |
| R-008380843-000F | 2401 | 196 | GGAUGAUCCUAGCUAUCGU | B GGAUGAUCCUAGCUAUCGUUsU B | 2059 |
| R-008380843-000F | 2401 | 196 | GGAUGAUCCUAGCUAUCGU | AcGAuAGcuAGGAucAuccUsU | 2056 |
| R-008381185-000U | 2401 | 196 | GGAUGAUCCUAGCUAUCGU | B GGAUGAUCCUAGCUAUCGUUsU B | 2060 |
| R-008381185-000U | 2401 | 196 | GGAUGAUCCUAGCUAUCGU | AcGAuAGcuAGGAucAuccUsU | 2056 |
| R-008380951-000R | 2401 | 196 | GGAUGAUCCUAGCUAUCGU | B GGAuGAuccuAGcuAucGuUsU B | 2061 |
| R-008380951-000R | 2401 | 196 | GGAUGAUCCUAGCUAUCGU | AcGAuAGcuAGGAucAuccUsU | 2056 |
| R-008380804-000V | 2401 | 196 | GGAUGAUCCUAGCUAUCGU | B GGAUGAUCCUAGCUAUCGUUsU B | 2059 |
| R-008380804-000V | 2401 | 196 | GGAUGAUCCUAGCUAUCGU | ACGaUagCUaggaUCaUCCUsU | 2062 |
| R-008381179-000L | 2401 | 196 | GGAUGAUCCUAGCUAUCGU | B GGAUGAUCCUAGCUAUCGUUsU B | 2060 |
| R-008381179-000L | 2401 | 196 | GGAUGAUCCUAGCUAUCGU | ACGaUagCUaggaUCaUCCUsU | 2062 |
| R-008381127-000G | 2401 | 196 | GGAUGAUCCUAGCUAUCGU | ACGaUagCUaggaUCaUCCUsU | 2062 |
| R-008381127-000G | 2401 | 196 | GGAUGAUCCUAGCUAUCGU | B GGAuGAuccuAGcuAucGuUsU B | 2061 |
| R-008380945-000H | 2401 | 196 | GGAUGAUCCUAGCUAUCGU | B GGAUGAUCCUAGCUAUCGUUsU B | 2059 |
| R-008380945-000H | 2401 | 196 | GGAUGAUCCUAGCUAUCGU | ACGAUAGCUAGGAUCAUCCUsU | 2063 |
| R-008381071-000G | 2401 | 196 | GGAUGAUCCUAGCUAUCGU | B GGAUGAUCCUAGCUAUCGUUsU B | 2060 |
| R-008381071-000G | 2401 | 196 | GGAUGAUCCUAGCUAUCGU | ACGAUAGCUAGGAUCAUCCUsU | 2063 |
| R-008381173-000J | 2401 | 196 | GGAUGAUCCUAGCUAUCGU | B GGAuGAuccuAGcuAucGuUsU B | 2061 |
| R-008381173-000J | 2401 | 196 | GGAUGAUCCUAGCUAUCGU | ACGAUAGCUAGGAUCAUCCUsU | 2063 |
| R-008381122-000N | 2401 | 196 | GGAUGAUCCUAGCUAUCGU | B GGAUGAUCCUAGCUAUCGUUsU B | 2059 |
| R-008381122-000N | 2401 | 196 | GGAUGAUCCUAGCUAUCGU | ACGAUAGCUAGGAUCAUCCUsU | 2064 |
| R-008380801-000U | 2401 | 196 | GGAUGAUCCUAGCUAUCGU | B GGAUGAUCCUAGCUAUCGUUsU B | 2060 |
| R-008380801-000U | 2401 | 196 | GGAUGAUCCUAGCUAUCGU | ACGAUAGCUAGGAUCAUCCUsU | 2064 |
| R-008380839-000R | 2401 | 196 | GGAUGAUCCUAGCUAUCGU | B GGAuGAuccuAGcuAucGuUsU B | 2061 |
| R-008380839-000R | 2401 | 196 | GGAUGAUCCUAGCUAUCGU | ACGAUAGCUAGGAUCAUCCUsU | 2064 |
| R-008380835-000F | 2401 | 196 | GGAUGAUCCUAGCUAUCGU | ACGAuAGcuAGGAucAuccUsU | 2058 |
| R-008380835-000F | 2401 | 196 | GGAUGAUCCUAGCUAUCGU | B GGAUGAUCCUAGCUAUCGUUsU B | 2059 |
| R-008381258-000C | 2401 | 196 | GGAUGAUCCUAGCUAUCGU | ACGAuAGcuAGGAucAuccUsU | 2058 |
| R-008381258-000C | 2401 | 196 | GGAUGAUCCUAGCUAUCGU | B GGAUGAUCCUAGCUAUCGUUsU B | 2060 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008381169-000U | 2401 | 196 | GGAUGAUCCUAGCUAUCGU | ACGAuAGcuAGGAucAUccUsU | 2058 |
| R-008381169-000U | 2401 | 196 | GGAUGAUCCUAGCUAUCGU | B GGAuGAuccuAGcuAucGuUsU B | 2061 |
| R-008380937-000H | 2401 | 196 | GGAUGAUCCUAGCUAUCGU | B GGAUGAUCCUAGCUAUCGUUsU B | 2059 |
| R-008380937-000H | 2401 | 196 | GGAUGAUCCUAGCUAUCGU | ACGaUagCUaggaUCaUCCUsU | 2065 |
| R-008381251-000S | 2401 | 196 | GGAUGAUCCUAGCUAUCGU | B GGAUGAUCCUAGCUAUCGUUsU B | 2060 |
| R-008381251-000S | 2401 | 196 | GGAUGAUCCUAGCUAUCGU | ACGaUagCUaggaUCaUCCUsU | 2065 |
| R-008380933-000Y | 2401 | 196 | GGAUGAUCCUAGCUAUCGU | B GGAuGAuccuAGcuAucGuUsU B | 2061 |
| R-008380933-000Y | 2401 | 196 | GGAUGAUCCUAGCUAUCGU | ACGaUagCUaggaUCaUCCUsU | 2065 |
| R-008381748-000J | 1797 | 5 | CUGUUGGAUUGAUUCGAAA | B CUgUuGGAUUGAUUCGaAAUsU B | 2066 |
| R-008381748-000J | 1797 | 5 | CUGUUGGAUUGAUUCGAAA | UUUCGaAUCAauccaACAGUsU | 2067 |
| R-008381708-000P | 1797 | 5 | CUGUUGGAUUGAUUCGAAA | B CUGUuGGaUUGaUUCGAAaUsU B | 2069 |
| R-008381708-000P | 1797 | 5 | CUGUUGGAUUGAUUCGAAA | uuucGAauCaAUCcAaCaGUsU | 2068 |
| R-008381704-000E | 1797 | 5 | CUGUUGGAUUGAUUCGAAA | uUUcgAaUCaAuCCAACAGUsU | 2070 |
| R-008381704-000E | 1797 | 5 | CUGUUGGAUUGAUUCGAAA | B CUGUUuGgaUUGAUuCGaAAUsU B | 2071 |
| R-008381746-000S | 1797 | 5 | CUGUUGGAUUGAUUCGAAA | UUUCGaaUCAAUCcAacaGUsU | 2073 |
| R-008381746-000S | 1797 | 5 | CUGUUGGAUUGAUUCGAAA | B CUgUUGgaUUGaUUCgAAAUsU B | 2072 |
| R-008381728-000Z | 1797 | 5 | CUGUUGGAUUGAUUCGAAA | B CUgUUGGAUUGAUUCgAAAUsU B | 2074 |
| R-008381728-000Z | 1797 | 5 | CUGUUGGAUUGAUUCGAAA | UUucGaAUCAUCcAACagUsU | 2075 |
| R-008381686-000B | 1797 | 5 | CUGUUGGAUUGAUUCGAAA | uuUCGAAUcaaUCCAAcAgUsU | 2076 |
| R-008381686-000B | 1797 | 5 | CUGUUGGAUUGAUUCGAAA | B CuGUUGgaUUgAuUCGAaaUsU B | 2077 |
| R-008381726-000G | 1797 | 5 | CUGUUGGAUUGAUUCGAAA | uuUcGAAUCaaUcCAACaGUsU | 2078 |
| R-008381726-000G | 1797 | 5 | CUGUUGGAUUGAUUCGAAA | B CUgUUgGaUUGAUUCGaAAUsU B | 2079 |
| R-008381629-000Y | 1797 | 5 | CUGUUGGAUUGAUUCGAAA | UUUcGAAUCaaUCCAacAGUsU | 2081 |
| R-008381629-000Y | 1797 | 5 | CUGUUGGAUUGAUUCGAAA | B CUGUUGAUUGaUUCGAaAUsU B | 2080 |
| R-008381724-000P | 1797 | 5 | CUGUUGGAUUGAUUCGAAA | B CUgUUGGAUUgAUUCgAAAUsU B | 2083 |
| R-008381724-000P | 1797 | 5 | CUGUUGGAUUGAUUCGAAA | uuuCgaAUCAAUCcAACagUsU | 2082 |
| R-008381670-000G | 1797 | 5 | CUGUUGGAUUGAUUCGAAA | B CugUUGGAUUGaUUCgaaaUsU B | 2084 |
| R-008381670-000G | 1797 | 5 | CUGUUGGAUUGAUUCGAAA | UuuCgAAUCAAUCcaACAGUsU | 2085 |
| R-008381666-000S | 1797 | 5 | CUGUUGGAUUGAUUCGAAA | UuuCGaauCaAUccaACAGUsU | 2087 |
| R-008381666-000S | 1797 | 5 | CUGUUGGAUUGAUUCGAAA | B CUGUUgGaUUgaUCGaAAUsU B | 2086 |
| R-008381722-000X | 1797 | 5 | CUGUUGGAUUGAUUCGAAA | B CUGUUgGAUUGAUUCgAAAUsU B | 2088 |
| R-008381722-000X | 1797 | 5 | CUGUUGGAUUGAUUCGAAA | UUUCgAauCAAUCcAcagUsU | 2089 |
| R-008381700-000V | 1797 | 5 | CUGUUGGAUUGAUUCGAAA | uUuCGAAUCaAUCcaaCAGUsU | 2090 |
| R-008381700-000V | 1797 | 5 | CUGUUGGAUUGAUUCGAAA | B CUgUUggAUUgaUUCGaAAUsU B | 2091 |
| R-008381650-000X | 1797 | 5 | CUGUUGGAUUGAUUCGAAA | UuUCGAAUCaAUCaACAGUsU | 2093 |
| R-008381650-000X | 1797 | 5 | CUGUUGGAUUGAUUCGAAA | B CUGUUGGaUUGaUUCGAAAUsU B | 2092 |
| R-008381647-000R | 1797 | 5 | CUGUUGGAUUGAUUCGAAA | B CUGUUGGaUUgaUUCGAaaUsU B | 2094 |
| R-008381647-000R | 1797 | 5 | CUGUUGGAUUGAUUCGAAA | UUUCgAAuCAaUCcaaCAGUsU | 2095 |
| R-008381624-000E | 1797 | 5 | CUGUUGGAUUGAUUCGAAA | UUUCgAAUCAauCCACAGUsU | 2097 |
| R-008381624-000E | 1797 | 5 | CUGUUGGAUUGAUUCGAAA | B CuGuUgGAUUgaUUCGAaAUsU B | 2096 |
| R-008381682-000S | 1797 | 5 | CUGUUGGAUUGAUUCGAAA | B CUGUUGgAUUGAUUCGaaaUsU B | 2098 |
| R-008381682-000S | 1797 | 5 | CUGUUGGAUUGAUUCGAAA | UUUcgaAUCAAUCCAACagUsU | 2099 |
| R-008381622-000M | 1797 | 5 | CUGUUGGAUUGAUUCGAAA | UUUcGAaUCaAUcACCAGUsU | 2101 |
| R-008381622-000M | 1797 | 5 | CUGUUGGAUUGAUUCGAAA | B CUgUUggaUUgaUUCgaaaUsU B | 2100 |
| R-008381680-000Z | 2398 | 151 | CCAGGAUGAUCCUAGCUAU | AuaGCUAggAUCAUCCuGGUsU | 2103 |
| R-008381680-000Z | 2398 | 151 | CCAGGAUGAUCCUAGCUAU | B CCAGGAUGaUcCUaGCUAUUsU B | 2102 |
| R-008381606-000M | 2398 | 151 | CCAGGAUGAUCCUAGCUAU | B CCAGgaUGaUCCUAgCUAUUsU B | 2104 |
| R-008381606-000M | 2398 | 151 | CCAGGAUGAUCCUAGCUAU | AUAgcuaGgaUCAUCcUGgUsU | 2105 |
| R-008381714-000X | 2398 | 151 | CCAGGAUGAUCCUAGCUAU | aUagCUAGGaUCauccUGGUsU | 2106 |
| R-008381714-000X | 2398 | 151 | CCAGGAUGAUCCUAGCUAU | B CCagGAUgAUCCUAGCUaUUsU B | 2107 |
| R-008381642-000X | 2398 | 151 | CCAGGAUGAUCCUAGCUAU | B CCAGGAUGAUCCUAGCUaUUsU B | 2109 |
| R-008381642-000X | 2398 | 151 | CCAGGAUGAUCCUAGCUAU | aUagCuagGAUCAucCugGUsU | 2108 |
| R-008381662-000G | 2398 | 151 | CCAGGAUGAUCCUAGCUAU | AUAGcUAgGAUCaUCcUGgUsU | 2111 |
| R-008381662-000G | 2398 | 151 | CCAGGAUGAUCCUAGCUAU | B cCAGgAUgAUCCUagCUAUUsU B | 2110 |
| R-008381618-000X | 2398 | 151 | CCAGGAUGAUCCUAGCUAU | auAgCUAGgAUCauCaCCUGGUsU | 2112 |
| R-008381618-000X | 2398 | 151 | CCAGGAUGAUCCUAGCUAU | B CCAGGAUGAUCCUAGCUAUUsU B | 2113 |
| R-008381698-000L | 2398 | 151 | CCAGGAUGAUCCUAGCUAU | aUaGCuaggAUcaUCUGGUsU | 2114 |
| R-008381698-000L | 2398 | 151 | CCAGGAUGAUCCUAGCUAU | B CCAGGAUGAUCCUAgCUaUUsU B | 2115 |
| R-008381742-000G | 2398 | 151 | CCAGGAUGAUCCUAGCUAU | B CCAgGAUgaUCCUaGCUAUUsU B | 2117 |
| R-008381742-000G | 2398 | 151 | CCAGGAUGAUCCUAGCUAU | aUagCUAggAUcAUCaCUgGUsU | 2116 |
| R-008381738-000S | 2398 | 151 | CCAGGAUGAUCCUAGCUAU | B CCaggaUgaUCCUagCUaUUsU B | 2118 |
| R-008381738-000S | 2398 | 151 | CCAGGAUGAUCCUAGCUAU | AUAggUaGGAUcauCCUGGUsU | 2119 |
| R-008381660-000P | 2398 | 151 | CCAGGAUGAUCCUAGCUAU | B CCAgGAUGAUCCUAGcUAUUsU B | 2121 |
| R-008381660-000P | 2398 | 151 | CCAGGAUGAUCCUAGCUAU | aUagcUAGGAUcaUCcUgGUsU | 2120 |
| R-008381696-000U | 2398 | 151 | CCAGGAUGAUCCUAGCUAU | B CCaGgAUGAUCCUAGCUAUUsU B | 2123 |
| R-008381696-000U | 2398 | 151 | CCAGGAUGAUCCUAGCUAU | auAgCUaggauCAUCCUGGUsU | 2122 |
| R-008381636-000P | 2398 | 151 | CCAGGAUGAUCCUAGCUAU | AUAGCUAGgaUCaUCcuGGUsU | 2125 |
| R-008381636-000P | 2398 | 151 | CCAGGAUGAUCCUAGCUAU | B CCaGaUgAUCCUAgCUAUUsU B | 2124 |
| R-008381634-000X | 2398 | 151 | CCAGGAUGAUCCUAGCUAU | AUaGCUagGAUcAUCCUgGUsU | 2127 |
| R-008381634-000X | 2398 | 151 | CCAGGAUGAUCCUAGCUAU | B cCAGGaUgAuCCUaGCUaUUsU B | 2126 |
| R-008381632-000E | 2398 | 151 | CCAGGAUGAUCCUAGCUAU | B CCaGgAUgAuCCUAGcUAUUsU B | 2129 |
| R-008381632-000E | 2398 | 151 | CCAGGAUGAUCCUAGCUAU | aUAGCuAGGAUCAUCCUggUsU | 2128 |
| R-008381736-000Z | 2398 | 151 | CCAGGAUGAUCCUAGCUAU | AUaGCuAGGaUcAUcCUgGUsU | 2131 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008381736-000Z | 2398 | 151 | CCAGGAUGAUCCUAGCUAU | B CcaggAuga*UCCUAGCU*a*UU*s*U* B | 2130 |
| R-008381600-000K | 2398 | 151 | CCAGGAUGAUCCUAGCUAU | a*U*aGc*U*agga*AUCA*uc*CUGGU*s*U* | 2132 |
| R-008381600-000K | 2398 | 151 | CCAGGAUGAUCCUAGCUAU | B CC*Ag*Ga*UGAUC*C*U*a*GCUAUU*s*U* B | 2133 |
| R-008381732-000P | 2398 | 151 | CCAGGAUGAUCCUAGCUAU | a*U*agC*u*AG*G*a*U*C*A*uc*CU*g*GU*s*U* | 2134 |
| R-008381732-000P | 2398 | 151 | CCAGGAUGAUCCUAGCUAU | B CC*A*gga*U*GA*UCC*UA*g*C*U*A*uU*s*U* B | 2135 |
| R-008381656-000Z | 2398 | 151 | CCAGGAUGAUCCUAGCUAU | B *C*C*A*G*g*A*UG*A*U*CC*UAG*c*ua*UU*s*U* B | 2136 |
| R-008381656-000Z | 2398 | 151 | CCAGGAUGAUCCUAGCUAU | Auag*C*U*A*g*G*au*C*A*U*c*CUGGU*s*U* | 2137 |
| R-008381750-000G | 1870 | 194 | ACGACUAGUUCAGUUGCUU | aag*C*A*A*C*U*G*a*A*C*u*A*G*U*C*g*UU*s*U* | 2138 |
| R-008381750-000G | 1870 | 194 | ACGACUAGUUCAGUUGCUU | B A*C*g*AC*u*A*g*UU*c*AG*UUGC*U*UU*s*U* B | 2139 |
| R-008381690-000S | 1870 | 194 | ACGACUAGUUCAGUUGCUU | a*A*G*C*A*A*C*U*Ga*A*C*U*a*GU*C*g*UU*s*U* | 2140 |
| R-008381690-000S | 1870 | 194 | ACGACUAGUUCAGUUGCUU | B a*CGAC*U*A*G*U*c*A*g*U*u*g*c*UU*s*U* B | 2141 |
| R-008381616-000E | 1870 | 194 | ACGACUAGUUCAGUUGCUU | *AAG*ca*AC*u*G*aa*C*U*A*G*U*C*GU*U*s*U* | 2143 |
| R-008381616-000E | 1870 | 194 | ACGACUAGUUCAGUUGCUU | B a*C*GA*C*U*ag*U*U*C*ag*U*U*g*C*U*UU*s*U* B | 2142 |
| R-008381688-000U | 1870 | 194 | ACGACUAGUUCAGUUGCUU | a*A*g*C*A*A*C*U*GA*A*C*U*A*g*U*c*GU*U*s*U* | 2144 |
| R-008381688-000U | 1870 | 194 | ACGACUAGUUCAGUUGCUU | B aCga*C*u*A*G*U*uc*A*g*U*U*gc*UU*s*U* B | 2145 |
| R-008381614-000M | 1870 | 194 | ACGACUAGUUCAGUUGCUU | B a*C*ga*CU*Agu*UC*A*G*U*U*G*C*U*UU*s*U* B | 2147 |
| R-008381614-000M | 1870 | 194 | ACGACUAGUUCAGUUGCUU | aa*GC*A*A*c*U*g*A*a*C*uag*Uc*GUU*s*U* | 2146 |
| R-008381706-000X | 1870 | 194 | ACGACUAGUUCAGUUGCUU | B A*C*ga*C*U*A*G*U*U*C*A*G*UU*G*C*u*UU*s*U* B | 2148 |
| R-008381706-000X | 1870 | 194 | ACGACUAGUUCAGUUGCUU | *A*Ag*CAA*c*U*Ga*A*C*U*a*G*U*C*g*UU*s*U* | 2149 |
| R-008381672-000Z | 1870 | 194 | ACGACUAGUUCAGUUGCUU | *A*Ag*C*A*A*c*ug*AA*c*U*ag*UC*GUU*s*U* | 2151 |
| R-008381672-000Z | 1870 | 194 | ACGACUAGUUCAGUUGCUU | B A*C*g*AC*U*AG*U*U*C*a*G*UU*G*c*UU*s*U* B | 2150 |
| R-008381730-000X | 1870 | 194 | ACGACUAGUUCAGUUGCUU | *A*agc*A*a*C*U*Ga*A*Cu*A*G*ucg*UU*s*U* | 2153 |
| R-008381730-000X | 1870 | 194 | ACGACUAGUUCAGUUGCUU | B ac*G*A*C*u*ag*UU*C*ag*U*u*GCU*U*U*s*U* B | 2152 |
| R-008381612-000V | 1870 | 194 | ACGACUAGUUCAGUUGCUU | B a*C*G*A*c*U*A*G*U*U*C*A*G*UU*g*C*U*UU*s*U* B | 2154 |
| R-008381612-000V | 1870 | 194 | ACGACUAGUUCAGUUGCUU | *A*a*GC*aA*c*U*GA*a*c*U*a*G*U*c*GU*U*s*U* | 2155 |
| R-008381702-000M | 1870 | 194 | ACGACUAGUUCAGUUGCUU | *A*Agca*A*c*U*G*AA*Cua*GU*C*GUU*s*U* | 2157 |
| R-008381702-000M | 1870 | 194 | ACGACUAGUUCAGUUGCUU | B *A*C*G*A*C*U*A*g*U*U*Ca*G*U*U*g*C*UU*U*s*U* B | 2156 |
| R-008381744-000Z | 1870 | 194 | ACGACUAGUUCAGUUGCUU | B A*C*GaC*U*a*G*U*U*Ca*G*U*UG*c*UU*U*s*U* B | 2158 |
| R-008381744-000Z | 1870 | 194 | ACGACUAGUUCAGUUGCUU | Aa*GCAA*C*U*Ga*A*C*U*A*G*u*C*GU*U*s*U* | 2159 |
| R-008381610-000C | 1870 | 194 | ACGACUAGUUCAGUUGCUU | a*A*g*CAA*C*U*G*A*ac*U*a*G*u*C*g*UU*s*U* | 2160 |
| R-008381610-000C | 1870 | 194 | ACGACUAGUUCAGUUGCUU | B A*CG*A*C*U*A*g*U*U*C*A*g*U*U*G*C*U*U*U*s*U* B | 2161 |
| R-008381608-000E | 1870 | 194 | ACGACUAGUUCAGUUGCUU | B A*C*Ga*C*U*a*G*u*U*Cag*U*UG*C*U*UU*s*U* B | 2162 |
| R-008381608-000E | 1870 | 194 | ACGACUAGUUCAGUUGCUU | *A*g*C*A*A*C*U*Ga*A*C*U*A*G*U*Cgu*U*s*U* | 2163 |
| R-008381654-000G | 1870 | 194 | ACGACUAGUUCAGUUGCUU | a*A*g*C*A*a*C*U*G*a*A*c*U*a*GU*C*g*UU*s*U* | 2164 |
| R-008381654-000G | 1870 | 194 | ACGACUAGUUCAGUUGCUU | B *AC*U*a*G*U*U*C*ag*U*U*g*C*U*U*U*s*U* B | 2165 |
| R-008381668-000J | 1870 | 194 | ACGACUAGUUCAGUUGCUU | B *A*CG*ACU*AG*UU*C*A*G*U*UGC*U*CU*U*s*U* B | 2167 |
| R-008381668-000J | 1870 | 194 | ACGACUAGUUCAGUUGCUU | a*A*g*C*A*A*C*U*ga*AA*C*u*ag*uC*g*UU*s*U* | 2166 |
| R-008381627-000F | 1870 | 194 | ACGACUAGUUCAGUUGCUU | B a*C*ga*C*U*A*G*U*U*C*a*G*U*U*G*C*U*UU*s*U* B | 2169 |
| R-008381627-000F | 1870 | 194 | ACGACUAGUUCAGUUGCUU | a*A*G*C*A*A*C*U*g*A*a*C*U*A*G*U*c*G*UU*s*U* | 2168 |
| R-008381719-000R | 1870 | 194 | ACGACUAGUUCAGUUGCUU | B A*C*G*A*c*U*A*g*U*u*C*A*g*U*U*G*C*U*UU*s*U* B | 2170 |
| R-008381719-000R | 1870 | 194 | ACGACUAGUUCAGUUGCUU | *A*A*GC*A*A*C*U*G*A*A*c*U*A*G*U*C*G*u*U*s*U* | 2171 |
| R-008381717-000Y | 1870 | 194 | ACGACUAGUUCAGUUGCUU | B a*C*ga*C*U*ag*U*U*C*ag*U*U*g*C*U*UU*s*U* B | 2173 |
| R-008381717-000Y | 1870 | 194 | ACGACUAGUUCAGUUGCUU | aa*G*C*A*A*C*U*Ga*A*C*U*A*gU*C*g*UU*s*U* | 2172 |
| R-008381652-000P | 2401 | 196 | GGAUGAUCCUAGCUAUCGU | *AC*ga*U*A*G*cu*A*G*gau*C*A*U*Cc*UU*s*U* | 2175 |
| R-008381652-000P | 2401 | 196 | GGAUGAUCCUAGCUAUCGU | B g*G*a*u*g*a*U*c*CU*A*G*C*U*A*U*C*g*UU*s*U* B | 2174 |
| R-008381684-000J | 2401 | 196 | GGAUGAUCCUAGCUAUCGU | B Gg*AU*Ga*UCC*uagc*U*A*UC*g*UU*s*U* B | 2177 |
| R-008381684-000J | 2401 | 196 | GGAUGAUCCUAGCUAUCGU | a*C*g*A*U*agcua*GG*AU*c*A*U*C*CU*s*U* | 2176 |
| R-008381664-000Z | 2401 | 196 | GGAUGAUCCUAGCUAUCGU | B *G*AU*g*A*U*CC*U*A*G*C*U*A*U*C*GU*U*s*U* B | 2179 |
| R-008381664-000Z | 2401 | 196 | GGAUGAUCCUAGCUAUCGU | a*CG*au*A*G*C*U*ag*G*au*C*a*U*CC*U*s*U* | 2178 |
| R-008381645-000Y | 2401 | 196 | GGAUGAUCCUAGCUAUCGU | acg*A*U*A*G*C*U*a*G*g*A*U*C*A*U*c*CU*s*U* | 2180 |
| R-008381645-000Y | 2401 | 196 | GGAUGAUCCUAGCUAUCGU | B *G*AU*G*A*U*CC*U*A*G*C*U*au*CGU*U*s*U* B | 2181 |
| R-008381678-000B | 2401 | 196 | GGAUGAUCCUAGCUAUCGU | *AC*ga*U*A*G*c*U*a*GG*A*U*C*A*U*Cc*U*s*U* | 2183 |
| R-008381678-000B | 2401 | 196 | GGAUGAUCCUAGCUAUCGU | B gga*U*ga*UCC*U*ag*C*U*a*U*C*g*UU*s*U* B | 2182 |
| R-008381620-000V | 2401 | 196 | GGAUGAUCCUAGCUAUCGU | a*C*gau*A*g*C*U*A*G*g*A*uca*U*c*C*U*s*U* | 2184 |
| R-008381620-000V | 2401 | 196 | GGAUGAUCCUAGCUAUCGU | B *GG*a*UGA*UCC*U*AG*C*U*a*U*C*g*UU*s*U* B | 2185 |
| R-008381712-000E | 2401 | 196 | GGAUGAUCCUAGCUAUCGU | a*C*GA*u*a*G*C*u*A*GG*A*U*c*A*UCC*U*s*U* | 2186 |
| R-008381712-000E | 2401 | 196 | GGAUGAUCCUAGCUAUCGU | B *GG*a*U*G*A*U*CC*U*a*G*C*U*A*U*C*g*UU*s*U* B | 2187 |
| R-008381710-000M | 2401 | 196 | GGAUGAUCCUAGCUAUCGU | B g*G*a*U*g*A*U*CC*U*a*G*C*U*A*U*C*g*UU*s*U* B | 2188 |
| R-008381710-000M | 2401 | 196 | GGAUGAUCCUAGCUAUCGU | *A*CG*A*u*A*g*c*U*a*GG*A*U*C*a*U*c*CU*s*U* | 2189 |
| R-008381676-000J | 2401 | 196 | GGAUGAUCCUAGCUAUCGU | a*CG*A*u*aa*G*C*U*A*GG*A*U*C*A*U*cc*U*s*U* | 2190 |
| R-008381676-000J | 2401 | 196 | GGAUGAUCCUAGCUAUCGU | B Gg*AU*Gau*CC*U*AGC*U*A*U*C*gu*UU*s*U* B | 2191 |
| R-008381604-000V | 2401 | 196 | GGAUGAUCCUAGCUAUCGU | B Gg*a*U*g*A*U*CC*U*a*G*C*U*A*U*C*g*UU*s*U* B | 2192 |
| R-008381604-000V | 2401 | 196 | GGAUGAUCCUAGCUAUCGU | *A*CG*A*u*A*g*C*U*agg*A*u*C*A*U*C*CU*s*U* | 2193 |
| R-008381640-000E | 2401 | 196 | GGAUGAUCCUAGCUAUCGU | B Gg*A*U*g*a*UCC*U*A*G*c*U*A*uc*g*UU*s*U* B | 2194 |
| R-008381640-000E | 2401 | 196 | GGAUGAUCCUAGCUAUCGU | *A*c*GAU*A*G*C*U*A*G*G*au*c*aU*C*CU*s*U* | 2195 |
| R-008381740-000P | 2401 | 196 | GGAUGAUCCUAGCUAUCGU | acg*A*ua*G*C*U*ag*G*au*C*A*U*Cc*UU*s*U* | 2196 |
| R-008381740-000P | 2401 | 196 | GGAUGAUCCUAGCUAUCGU | B Gg*A*U*GA*U*CC*U*ag*C*U*A*U*C*G*UU*s*U* B | 2197 |
| R-008381674-000S | 2401 | 196 | GGAUGAUCCUAGCUAUCGU | B *GGAUGAU*CC*U*aGc*U*A*U*CG*UU*s*U* B | 2199 |
| R-008381674-000S | 2401 | 196 | GGAUGAUCCUAGCUAUCGU | a*C*g*A*U*agc*U*A*GG*A*U*C*A*U*CC*U*s*U* | 2198 |
| R-008381694-000B | 2401 | 196 | GGAUGAUCCUAGCUAUCGU | B *Gg*A*U*Ga*U*CC*U*A*G*C*U*A*U*C*G*UU*s*U* B | 2201 |
| R-008381694-000B | 2401 | 196 | GGAUGAUCCUAGCUAUCGU | a*CG*A*U*a*GC*U*A*GG*au*C*a*U*C*CU*s*U* | 2200 |
| R-008381638-000G | 2401 | 196 | GGAUGAUCCUAGCUAUCGU | B *GG*A*U*g*A*U*CC*U*Ag*C*U*A*U*C*g*UU*s*U* B | 2203 |
| R-008381638-000G | 2401 | 196 | GGAUGAUCCUAGCUAUCGU | a*CG*a*U*agc*U*A*GG*A*U*Ca*U*c*U*s*U* | 2202 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008381602-000C | 2401 | 196 | GGAUGAUCCUAGCUAUCGU | B GGaUgaUCCuAGCuAUCGUUsU B | 2204 |
| R-008381602-000C | 2401 | 196 | GGAUGAUCCUAGCUAUCGU | AcGAUaGCUaGGauCAUccUsU | 2205 |
| R-008381692-000J | 2401 | 196 | GGAUGAUCCUAGCUAUCGU | AcgaUagCUAGGAUcAucCUsU | 2207 |
| R-008381692-000J | 2401 | 196 | GGAUGAUCCUAGCUAUCGU | B GGAUGAUCCUagCUAuCGUUsU B | 2206 |
| R-008381658-000S | 2401 | 196 | GGAUGAUCCUAGCUAUCGU | B gGAUgaUCCUAGCUaUCGUUsU B | 2208 |
| R-008381658-000S | 2401 | 196 | GGAUGAUCCUAGCUAUCGU | ACGaUAGcuaggAuCAUcCUsU | 2209 |
| R-008381178-000C | 1797 | 5 | CUGUUGGAUUGAUUCGAAA | B CUGUUGGAUUGAUUCGAAAUsU B | 2020 |
| R-008381178-000C | 1797 | 5 | CUGUUGGAUUGAUUCGAAA | UUUCGaAUCAauccaACAGUsU | 2067 |
| R-008380929-000H | 1797 | 5 | CUGUUGGAUUGAUUCGAAA | uuucGAauCaAUCcAaCaGUsU | 2068 |
| R-008380929-000H | 1797 | 5 | CUGUUGGAUUGAUUCGAAA | B CUGUUGGAUUGAUUCGAAAUsU B | 2021 |
| R-008381019-000X | 1797 | 5 | CUGUUGGAUUGAUUCGAAA | uUUcgAaUCaAuCCAACAGUsU | 2070 |
| R-008381019-000X | 1797 | 5 | CUGUUGGAUUGAUUCGAAA | B cuGuuGGAuuGAuucGAAAUsU B | 2022 |
| R-008381256-000K | 1797 | 5 | CUGUUGGAUUGAUUCGAAA | B CUGUUGGAUUGAUUCGAAAUsU B | 2020 |
| R-008381256-000K | 1797 | 5 | CUGUUGGAUUGAUUCGAAA | UUUCGaaUCAAUCcAacaGUsU | 2073 |
| R-008381552-000E | 1797 | 5 | CUGUUGGAUUGAUUCGAAA | B CUGUUGGAUUGAUUCGAAAUsU B | 2021 |
| R-008381552-000E | 1797 | 5 | CUGUUGGAUUGAUUCGAAA | UUucGaAUCAAUCcAAcagUsU | 2075 |
| R-008381002-000U | 1797 | 5 | CUGUUGGAUUGAUUCGAAA | uuUCGAAUcaaUCCAAcAgUsU | 2076 |
| R-008381002-000U | 1797 | 5 | CUGUUGGAUUGAUUCGAAA | B cuGuuGGAuuGAuucGAAAUsU B | 2022 |
| R-008381394-000X | 1797 | 5 | CUGUUGGAUUGAUUCGAAA | uuUcGAAUCaaUcCAACAGUsU | 2078 |
| R-008381394-000X | 1797 | 5 | CUGUUGGAUUGAUUCGAAA | B CUGUUGGAUUGAUUCGAAAUsU B | 2020 |
| R-008381383-000W | 1797 | 5 | CUGUUGGAUUGAUUCGAAA | UUucGAAuCaaUCCAacAGUsU | 2081 |
| R-008381383-000W | 1797 | 5 | CUGUUGGAUUGAUUCGAAA | B CUGUUGGAUUGAUUCGAAAUsU B | 2021 |
| R-008381093-000J | 1797 | 5 | CUGUUGGAUUGAUUCGAAA | B cuGuuGGAuuGAuucGAAAUsU B | 2022 |
| R-008381093-000J | 1797 | 5 | CUGUUGGAUUGAUUCGAAA | uuuCgaAUCAAUCcAACagUsU | 2082 |
| R-008381375-000W | 1797 | 5 | CUGUUGGAUUGAUUCGAAA | UuuCgAAUCAAUCcaACAGUsU | 2085 |
| R-008381375-000W | 1797 | 5 | CUGUUGGAUUGAUUCGAAA | B CUGUUGGAUUGAUUCGAAAUsU B | 2020 |
| R-008381543-000W | 1797 | 5 | CUGUUGGAUUGAUUCGAAA | UuuCGaauCAaUccaACAGUsU | 2087 |
| R-008381543-000W | 1797 | 5 | CUGUUGGAUUGAUUCGAAA | B CUGUUGGAUUGAUUCGAAAUsU B | 2021 |
| R-008381535-000W | 1797 | 5 | CUGUUGGAUUGAUUCGAAA | UUUCgAauCAAUCCAcAcagUsU | 2089 |
| R-008381535-000W | 1797 | 5 | CUGUUGGAUUGAUUCGAAA | B cuGuuGGAuuGAuucGAAAUsU B | 2022 |
| R-008381528-000E | 1797 | 5 | CUGUUGGAUUGAUUCGAAA | uUuCGAAUCAaUCcaaCAGUsU | 2090 |
| R-008381528-000E | 1797 | 5 | CUGUUGGAUUGAUUCGAAA | B CUGUUGGAUUGAUUCGAAAUsU B | 2020 |
| R-008381365-000D | 1797 | 5 | CUGUUGGAUUGAUUCGAAA | B CUGUUGGAUUGAUUCGAAAUsU B | 2021 |
| R-008381365-000D | 1797 | 5 | CUGUUGGAUUGAUUCGAAA | UuUCGAAUcaauCCaACAGUsU | 2093 |
| R-008381520-000K | 1797 | 5 | CUGUUGGAUUGAUUCGAAA | UUUCgAAUCAauCcaaCAGUsU | 2095 |
| R-008381520-000K | 1797 | 5 | CUGUUGGAUUGAUUCGAAA | B cuGuuGGAuuGAuucGAAAUsU B | 2022 |
| R-008380915-000F | 1797 | 5 | CUGUUGGAUUGAUUCGAAA | B CUGUUGGAUUGAUUCGAAAUsU B | 2020 |
| R-008380915-000F | 1797 | 5 | CUGUUGGAUUGAUUCGAAA | UUUCGaAUCAauCCAaCAGUsU | 2097 |
| R-008381359-000W | 1797 | 5 | CUGUUGGAUUGAUUCGAAA | UUUcgAaUcAAUcCAACagUsU | 2099 |
| R-008381359-000W | 1797 | 5 | CUGUUGGAUUGAUUCGAAA | B CUGUUGGAUUGAUUCGAAAUsU B | 2021 |
| R-008381249-000U | 1797 | 5 | CUGUUGGAUUGAUUCGAAA | B cuGuuGGAuuGAuucGAAAUsU B | 2022 |
| R-008381249-000U | 1797 | 5 | CUGUUGGAUUGAUUCGAAA | UUUcGAaUcaAUCcaACAGUsU | 2101 |
| R-008381082-000H | 2398 | 151 | CCAGGAUGAUCCUAGCUAU | B CCAGGAUGAUCCUAGCUAUUsU B | 2033 |
| R-008381082-000H | 2398 | 151 | CCAGGAUGAUCCUAGCUAU | AUaGCUAggAUCAuCCUgGUsU | 2103 |
| R-008381240-000R | 2398 | 151 | CCAGGAUGAUCCUAGCUAU | B CCAGGAUGAUCCUAGCUAUUsU B | 2034 |
| R-008381240-000R | 2398 | 151 | CCAGGAUGAUCCUAGCUAU | AUAgcuaGgaUCAuCcUGggUsU | 2105 |
| R-008380907-000F | 2398 | 151 | CCAGGAUGAUCCUAGCUAU | B cccAGGAuGAuccuAGcuAUUsU B | 2035 |
| R-008380907-000F | 2398 | 151 | CCAGGAUGAUCCUAGCUAU | aUagCUAGGaUCauccUGgUsU | 2106 |
| R-008381164-000A | 2398 | 151 | CCAGGAUGAUCCUAGCUAU | B CCAGGAUGAUCCUAGCUAUUsU B | 2033 |
| R-008381164-000A | 2398 | 151 | CCAGGAUGAUCCUAGCUAU | aUagCuagGAUCAucCugGUsU | 2108 |
| R-008381072-000R | 2398 | 151 | CCAGGAUGAUCCUAGCUAU | B CCAGGAUGAUCCUAGCUAUUsU B | 2034 |
| R-008381072-000R | 2398 | 151 | CCAGGAUGAUCCUAGCUAU | AUAGcUAgGAuCauCCUggUsU | 2111 |
| R-008381450-000C | 2398 | 151 | CCAGGAUGAUCCUAGCUAU | B ccAGGAuGAuccuAGcuAUUsU B | 2035 |
| R-008381450-000C | 2398 | 151 | CCAGGAUGAUCCUAGCUAU | auAgCUaGGAuCauCCUGGUsU | 2112 |
| R-008381059-000S | 2398 | 151 | CCAGGAUGAUCCUAGCUAU | B CCAGGAUGAUCCUAGCUAUUsU B | 2033 |
| R-008381059-000S | 2398 | 151 | CCAGGAUGAUCCUAGCUAU | aUaGCUaaggAUcaUcCUGGUsU | 2114 |
| R-008381154-000H | 2398 | 151 | CCAGGAUGAUCCUAGCUAU | aUagCUAggAUcAUcCuGgUsU | 2116 |
| R-008381154-000H | 2398 | 151 | CCAGGAUGAUCCUAGCUAU | B CCAGGAUGAUCCUAGCUAUUsU B | 2034 |
| R-008381443-000L | 2398 | 151 | CCAGGAUGAUCCUAGCUAU | AUAGCUaGGAUcauCCUgGUsU | 2119 |
| R-008381443-000L | 2398 | 151 | CCAGGAUGAUCCUAGCUAU | B ccAGGAuGAuccuAGcuAUUsU B | 2035 |
| R-008381049-000Z | 2398 | 151 | CCAGGAUGAUCCUAGCUAU | B CCAGGAUGAUCCUAGCUAUUsU B | 2033 |
| R-008381049-000Z | 2398 | 151 | CCAGGAUGAUCCUAGCUAU | aUagcUAGGAUcaUCugGUsU | 2120 |
| R-008381292-000V | 2398 | 151 | CCAGGAUGAUCCUAGCUAU | auAGcUaggauCAUCCUGGUsU | 2122 |
| R-008381292-000V | 2398 | 151 | CCAGGAUGAUCCUAGCUAU | B CCAGGAUGAUCCUAGCUAUUsU B | 2034 |
| R-008381010-000U | 2398 | 151 | CCAGGAUGAUCCUAGCUAU | AUAGCUAGgaUCauCcuGGUsU | 2125 |
| R-008381010-000U | 2398 | 151 | CCAGGAUGAUCCUAGCUAU | B ccAGGAuGAuccuAGcAUUsU B | 2035 |
| R-008381284-000V | 2398 | 151 | CCAGGAUGAUCCUAGCUAU | B CCAGGAUGAUCCUAGCUAUUsU B | 2033 |
| R-008381284-000V | 2398 | 151 | CCAGGAUGAUCCUAGCUAU | AUaGCUAgGrAucACCUGgUsU | 2127 |
| R-008381417-000U | 2398 | 151 | CCAGGAUGAUCCUAGCUAU | aUAGCUaAGGAUCAUCcUggUsU | 2128 |
| R-008381417-000U | 2398 | 151 | CCAGGAUGAUCCUAGCUAU | B CCAGGAUGAUCCUAGCUAUUsU B | 2034 |
| R-008381265-000U | 2398 | 151 | CCAGGAUGAUCCUAGCUAU | AUaGCuAGGAUcAUcCUGgUsU | 2131 |
| R-008381265-000U | 2398 | 151 | CCAGGAUGAUCCUAGCUAU | B ccAGGAuGAuccuAGcAUUsU B | 2035 |
| R-008381464-000E | 2398 | 151 | CCAGGAUGAUCCUAGCUAU | B CCAGGAUGAUCCUAGCUAUUsU B | 2033 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008381464-000E | 2398 | 151 | CCAGGAUGAUCCUAGCUAU | aUaGcUaggAUCAucCUGGUsU | 2132 |
| R-008381170-000H | 2398 | 151 | CCAGGAUGAUCCUAGCUAU | aUagCuAGGaUCAucCuGgUsU | 2134 |
| R-008381170-000H | 2398 | 151 | CCAGGAUGAUCCUAGCUAU | B CCAGGAUGAUCCUAGCUAUUsU B | 2034 |
| R-008381408-000K | 2398 | 151 | CCAGGAUGAUCCUAGCUAU | B ccAGGAuGAuccuAGcuAUUsU B | 2035 |
| R-008381408-000K | 2398 | 151 | CCAGGAUGAUCCUAGCUAU | AuagCUAgGauCAUcCUGGUsU | 2137 |
| R-008381110-000D | 1870 | 194 | ACGACUAGUUCAGUUGCUU | aagCAaCUGaAcuAGUCgUUsU | 2138 |
| R-008381110-000D | 1870 | 194 | ACGACUAGUUCAGUUGCUU | B ACGACUAGUUCAGUUGCUUUsU B | 2046 |
| R-008381558-000G | 1870 | 194 | ACGACUAGUUCAGUUGCUU | aAGcAACUGAaCUaGUCgUuUsU | 2140 |
| R-008381558-000G | 1870 | 194 | ACGACUAGUUCAGUUGCUU | B ACGACUAGUUCAGUUGCUUUsU B | 2047 |
| R-008381456-000E | 1870 | 194 | ACGACUAGUUCAGUUGCUU | AAGcaACuGaaCUaGuCGUUsU | 2143 |
| R-008381456-000E | 1870 | 194 | ACGACUAGUUCAGUUGCUU | B AcGAcuAGuucAGuuGcuuUsU B | 2048 |
| R-008381401-000Z | 1870 | 194 | ACGACUAGUUCAGUUGCUU | B ACGACUAGUUCAGUUGCUUUsU B | 2046 |
| R-008381401-000Z | 1870 | 194 | ACGACUAGUUCAGUUGCUU | aAgCaAcUGAACUAgUcGUUsU | 2144 |
| R-008380922-000X | 1870 | 194 | ACGACUAGUUCAGUUGCUU | aaGCAAcUgAaCuagUcGUUsU | 2146 |
| R-008380922-000X | 1870 | 194 | ACGACUAGUUCAGUUGCUU | B ACGACUAGUUCAGUUGCUUUsU B | 2047 |
| R-008381101-000V | 1870 | 194 | ACGACUAGUUCAGUUGCUU | AAgCAAcUGaACUaGUcgUUsU | 2149 |
| R-008381101-000V | 1870 | 194 | ACGACUAGUUCAGUUGCUU | B AcGAcuAGuucAGuuGcuuUsU B | 2048 |
| R-008381556-000P | 1870 | 194 | ACGACUAGUUCAGUUGCUU | AAgCAacugAAcUagUCGUUsU | 2151 |
| R-008381556-000P | 1870 | 194 | ACGACUAGUUCAGUUGCUU | B ACGACUAGUUCAGUUGCUUUsU B | 2046 |
| R-008381426-000C | 1870 | 194 | ACGACUAGUUCAGUUGCUU | AagcAaCUgaaCUAGucgUUsU | 2153 |
| R-008381426-000C | 1870 | 194 | ACGACUAGUUCAGUUGCUU | B ACGACUAGUUCAGUUGCUUUsU B | 2047 |
| R-008380979-000V | 1870 | 194 | ACGACUAGUUCAGUUGCUU | AaGCaACUGAacUaGUcGUUsU | 2155 |
| R-008380979-000V | 1870 | 194 | ACGACUAGUUCAGUUGCUU | B AcGAcuAGuucAGuuGcuuUsU B | 2048 |
| R-008380882-000S | 1870 | 194 | ACGACUAGUUCAGUUGCUU | B ACGACUAGUUCAGUUGCUUUsU B | 2046 |
| R-008380882-000S | 1870 | 194 | ACGACUAGUUCAGUUGCUU | AAgcaaCUGAACuaGUCGUUsU | 2157 |
| R-008381204-000F | 1870 | 194 | ACGACUAGUUCAGUUGCUU | AaGCAACUgaACUAGuCGUUsU | 2159 |
| R-008381204-000F | 1870 | 194 | ACGACUAGUUCAGUUGCUU | B ACGACUAGUUCAGUUGCUUUsU B | 2047 |
| R-008381471-000W | 1870 | 194 | ACGACUAGUUCAGUUGCUU | aAgCAACUGAacUaGuCgUUsU | 2160 |
| R-008381471-000W | 1870 | 194 | ACGACUAGUUCAGUUGCUU | B AcGAcuAGuucAGuuGcuuUsU B | 2048 |
| R-008381197-000D | 1870 | 194 | ACGACUAGUUCAGUUGCUU | B ACGACUAGUUCAGUUGCUUUsU B | 2046 |
| R-008381197-000D | 1870 | 194 | ACGACUAGUUCAGUUGCUU | AAgCAACUGAaCUaGUCgUUsU | 2163 |
| R-008380970-000S | 1870 | 194 | ACGACUAGUUCAGUUGCUU | aAgCAaCuGaAcuaGUCgUUsU | 2164 |
| R-008380970-000S | 1870 | 194 | ACGACUAGUUCAGUUGCUU | B ACGACUAGUUCAGUUGCUUUsU B | 2047 |
| R-008381511-000B | 1870 | 194 | ACGACUAGUUCAGUUGCUU | aAgCAAcugAACuaguCgUUsU | 2166 |
| R-008381511-000B | 1870 | 194 | ACGACUAGUUCAGUUGCUU | B AcGAcuAGuucAGuuGcuuUsU B | 2048 |
| R-008380992-000U | 1870 | 194 | ACGACUAGUUCAGUUGCUU | B ACGACUAGUUCAGUUGCUUUsU B | 2046 |
| R-008380992-000U | 1870 | 194 | ACGACUAGUUCAGUUGCUU | aAGCAacUgaACUaGUcGUUsU | 2168 |
| R-008381233-000Z | 1870 | 194 | ACGACUAGUUCAGUUGCUU | AAGCAACUGAaCUaGUCGUUsU | 2171 |
| R-008381233-000Z | 1870 | 194 | ACGACUAGUUCAGUUGCUU | B ACGACUAGUUCAGUUGCUUUsU B | 2047 |
| R-008381352-000K | 1870 | 194 | ACGACUAGUUCAGUUGCUU | B AcGAcuAGuucAGuuGcuuUsU B | 2048 |
| R-008381352-000K | 1870 | 194 | ACGACUAGUUCAGUUGCUU | aaGCAACuGaACUagUcGUUsU | 2172 |
| R-008380987-000V | 2401 | 196 | GGAUGAUCCUAGCUAUCGU | ACgaUAGcuAGgauCAUCcUsU | 2175 |
| R-008380987-000V | 2401 | 196 | GGAUGAUCCUAGCUAUCGU | B GGAUGAUCCUAGCUAUCGUUsU B | 2059 |
| R-008381345-000U | 2401 | 196 | GGAUGAUCCUAGCUAUCGU | B GGAUGAUCCUAGCUAUCGUUsU B | 2060 |
| R-008381345-000U | 2401 | 196 | GGAUGAUCCUAGCUAUCGU | aCgAUagcuaGGAUcAUCCUsU | 2176 |
| R-008381146-000H | 2401 | 196 | GGAUGAUCCUAGCUAUCGU | aCGauAGCuAgGaUcaUCCUsU | 2178 |
| R-008381146-000H | 2401 | 196 | GGAUGAUCCUAGCUAUCGU | B GGAuGAuccuAGcuAucGuUsU B | 2061 |
| R-008381503-000B | 2401 | 196 | GGAUGAUCCUAGCUAUCGU | B GGAUGAUCCUAGCUAUCGUUsU B | 2059 |
| R-008381503-000B | 2401 | 196 | GGAUGAUCCUAGCUAUCGU | acgAUAGCUaGgAUCAuCCUsU | 2180 |
| R-008381137-000Z | 2401 | 196 | GGAUGAUCCUAGCUAUCGU | B GGAUGAUCCUAGCUAUCGUUsU B | 2060 |
| R-008381137-000Z | 2401 | 196 | GGAUGAUCCUAGCUAUCGU | ACgaUAgCuAGGAUCAUCcUsU | 2183 |
| R-008381337-000U | 2401 | 196 | GGAUGAUCCUAGCUAUCGU | aCgauAgCUAggAucaUcCUsU | 2184 |
| R-008381337-000U | 2401 | 196 | GGAUGAUCCUAGCUAUCGU | B GGAuGAuccuAGcuAucGuUsU B | 2061 |
| R-008380900-000V | 2401 | 196 | GGAUGAUCCUAGCUAUCGU | B GGAUGAUCCUAGCUAUCGUUsU B | 2059 |
| R-008380900-000V | 2401 | 196 | GGAUGAUCCUAGCUAUCGU | aCGAuaGCuAGGAuCaUCCUsU | 2186 |
| R-008381328-000K | 2401 | 196 | GGAUGAUCCUAGCUAUCGU | B GGAUGAUCCUAGCUAUCGUUsU B | 2060 |
| R-008381328-000K | 2401 | 196 | GGAUGAUCCUAGCUAUCGU | ACGAuAgcUaGGAUCauCCUsU | 2189 |
| R-008381222-000Y | 2401 | 196 | GGAUGAUCCUAGCUAUCGU | B GGAuGAuccuAGcuAucGuUsU B | 2061 |
| R-008381222-000Y | 2401 | 196 | GGAUGAUCCUAGCUAUCGU | aCGAuaGCUAGgAUCaUccUsU | 2190 |
| R-008381494-000G | 2401 | 196 | GGAUGAUCCUAGCUAUCGU | ACGAuAgCUagGAuCAUCcUsU | 2193 |
| R-008381494-000G | 2401 | 196 | GGAUGAUCCUAGCUAUCGU | B GGAUGAUCCUAGCUAUCGUUsU B | 2059 |
| R-008381212-000F | 2401 | 196 | GGAUGAUCCUAGCUAUCGU | B GGAUGAUCCUAGCUAUCGUUsU B | 2060 |
| R-008381212-000F | 2401 | 196 | GGAUGAUCCUAGCUAUCGU | ACgAUAGCUAGgaucaUCCUsU | 2195 |
| R-008381434-000C | 2401 | 196 | GGAUGAUCCUAGCUAUCGU | B GGAuGAuccuAGcuAucGuUsU B | 2061 |
| R-008381434-000C | 2401 | 196 | GGAUGAUCCUAGCUAUCGU | acgAuaGCUagGauCAUcCUsU | 2196 |
| R-008380895-000K | 2401 | 196 | GGAUGAUCCUAGCUAUCGU | B GGAUGAUCCUAGCUAUCGUUsU B | 2059 |
| R-008380895-000K | 2401 | 196 | GGAUGAUCCUAGCUAUCGU | aCgAUagcUAGGAUCAuCCUsU | 2198 |
| R-008381488-000Z | 2401 | 196 | GGAUGAUCCUAGCUAUCGU | B GGAUGAUCCUAGCUAUCGUUsU B | 2060 |
| R-008381488-000Z | 2401 | 196 | GGAUGAUCCUAGCUAUCGU | aCGAUAGCuAGGaucCauCCUsU | 2200 |
| R-008381126-000Y | 2401 | 196 | GGAUGAUCCUAGCUAUCGU | aCGAUagcUAgGAUCAuCcUsU | 2202 |
| R-008381126-000Y | 2401 | 196 | GGAUGAUCCUAGCUAUCGU | B GGAuGAuccuAGcuAucGuUsU B | 2061 |
| R-008381479-000R | 2401 | 196 | GGAUGAUCCUAGCUAUCGU | B GGAUGAUCCUAGCUAUCGUUsU B | 2059 |
| R-008381479-000R | 2401 | 196 | GGAUGAUCCUAGCUAUCGU | AcGAUaGCUaGGauCAUccUsU | 2205 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008381319-000B | 2401 | 196 | GGAUGAUCCUAGCUAUCGU | AcgaUagCUAGGAUcAucCUsU | 2207 |
| R-008381319-000B | 2401 | 196 | GGAUGAUCCUAGCUAUCGU | B GGAUGAUCCUAGCUAUCGUUsU B | 2060 |
| R-008380889-000C | 2401 | 196 | GGAUGAUCCUAGCUAUCGU | B GGAuGAuccuAGcuAucGuUsU B | 2061 |
| R-008380889-000C | 2401 | 196 | GGAUGAUCCUAGCUAUCGU | ACGaUAGcuaggAuCAUcCUsU | 2209 |
| R-008381831-000R | 1797 | 5 | CUGUUGGAUUGAUUCGAAA | B CUgUuGGAUUGAUUCGaAAUsU B | 2066 |
| R-008381831-000R | 1797 | 5 | CUGUUGGAUUGAUUCGAAA | uuucGAAucAAuccAAcAGUsU | 2016 |
| R-008381842-000S | 1797 | 5 | CUGUUGGAUUGAUUCGAAA | B CUGUuGGaUUGaUUCGAAaUsU B | 2069 |
| R-008381842-000S | 1797 | 5 | CUGUUGGAUUGAUUCGAAA | uuucGAAucAAuccAAcAGUsU | 2016 |
| R-008381850-000S | 1797 | 5 | CUGUUGGAUUGAUUCGAAA | B CUGUuGgaUUGAUuCGaAAUsU B | 2071 |
| R-008381850-000S | 1797 | 5 | CUGUUGGAUUGAUUCGAAA | uuucGAAucAAuccAAcAGUsU | 2016 |
| R-008381815-000R | 1797 | 5 | CUGUUGGAUUGAUUCGAAA | UUUCgaaUCaaUCCaaCagUsU | 2023 |
| R-008381815-000R | 1797 | 5 | CUGUUGGAUUGAUUCGAAA | B CUgUUGgaUUGaUUCgAAAUsU B | 2072 |
| R-008381783-000K | 1797 | 5 | CUGUUGGAUUGAUUCGAAA | B CUgUUGGAUUGAUUCgAAAUsU B | 2074 |
| R-008381783-000K | 1797 | 5 | CUGUUGGAUUGAUUCGAAA | UUUCgaaUCaaUCCaaCagUsU | 2023 |
| R-008381799-000E | 1797 | 5 | CUGUUGGAUUGAUUCGAAA | B CuGUUGgaUUgAuUCGAaaUsU B | 2077 |
| R-008381799-000E | 1797 | 5 | CUGUUGGAUUGAUUCGAAA | UUUCgaaUCaaUCCaaCagUsU | 2023 |
| R-008381814-000G | 1797 | 5 | CUGUUGGAUUGAUUCGAAA | B CUgUUGGaUUGAUUCGaaaAUsU B | 2079 |
| R-008381814-000G | 1797 | 5 | CUGUUGGAUUGAUUCGAAA | UUUCGAAUCAAUCCAACAGUsU | 2024 |
| R-008381780-000J | 1797 | 5 | CUGUUGGAUUGAUUCGAAA | UUUCGAAUCAAUCCAACAGUsU | 2024 |
| R-008381780-000J | 1797 | 5 | CUGUUGGAUUGAUUCGAAA | B CUGUUGGAUUGaUUCGAaAUsU B | 2080 |
| R-008381841-000H | 1797 | 5 | CUGUUGGAUUGAUUCGAAA | B CUgUUGgAUugAUUCgAAAUsU B | 2083 |
| R-008381841-000H | 1797 | 5 | CUGUUGGAUUGAUUCGAAA | UUUCGAAUCAAUCCAACAGUsU | 2024 |
| R-008381791-000K | 1797 | 5 | CUGUUGGAUUGAUUCGAAA | B CugUUGGAUUGaUUCgaaaUsU B | 2084 |
| R-008381791-000K | 1797 | 5 | CUGUUGGAUUGAUUCGAAA | UUUCGAAUCAAUCCAACAGUsU | 2025 |
| R-008381839-000K | 1797 | 5 | CUGUUGGAUUGAUUCGAAA | UUUCGAAUCAAUCCAACAGUsU | 2025 |
| R-008381839-000K | 1797 | 5 | CUGUUGGAUUGAUUCGAAA | B CUgUUGgaUugAUuCGaAAUsU B | 2086 |
| R-008381796-000D | 1797 | 5 | CUGUUGGAUUGAUUCGAAA | B CUGUUgGAUUGAUUCgAAAUsU B | 2088 |
| R-008381796-000D | 1797 | 5 | CUGUUGGAUUGAUUCGAAA | UUUCGAAUCAAUCCAACAGUsU | 2025 |
| R-008381838-000B | 1797 | 5 | CUGUUGGAUUGAUUCGAAA | UUUcGAAucAAuccAAcAGUsU | 2019 |
| R-008381838-000B | 1797 | 5 | CUGUUGGAUUGAUUCGAAA | B CUgUUGgAUUgaUUCGAAAUsU B | 2091 |
| R-008381790-000B | 1797 | 5 | CUGUUGGAUUGAUUCGAAA | B CUGUUGGaUGaUUCGAAAUsU B | 2092 |
| R-008381790-000B | 1797 | 5 | CUGUUGGAUUGAUUCGAAA | UUUcGAAcAAuccAAcAGUsU | 2019 |
| R-008381825-000H | 1797 | 5 | CUGUUGGAUUGAUUCGAAA | B CUGUUGgAUUgaUUCGAaaUsU B | 2094 |
| R-008381825-000H | 1797 | 5 | CUGUUGGAUUGAUUCGAAA | UUUcGAAucAAuccAAcAGUsU | 2019 |
| R-008381789-000M | 1797 | 5 | CUGUUGGAUUGAUUCGAAA | UUUCgaaUCaaUCCaaCagUsU | 2026 |
| R-008381789-000M | 1797 | 5 | CUGUUGGAUUGAUUCGAAA | B CuGuUgGAUUgUUCGAaAUsU B | 2096 |
| R-008381805-000Y | 1797 | 5 | CUGUUGGAUUGAUUCGAAA | UUUCgaaUCaaUCCaaCagUsU | 2026 |
| R-008381805-000Y | 1797 | 5 | CUGUUGGAUUGAUUCGAAA | B CUGUUGgAUUGAUUCGaaaUsU B | 2098 |
| R-008381788-000D | 1797 | 5 | CUGUUGGAUUGAUUCGAAA | UUUCgaaUCaaUCCaaCagUsU | 2026 |
| R-008381788-000D | 1797 | 5 | CUGUUGGAUUGAUUCGAAA | B CUgUUggaUUgaUUCgaaaUsU B | 2100 |
| R-008381847-000K | 2398 | 151 | CCAGGAUGAUCCUAGCUAU | B CCAGGAUgaUcCUaGCUAUUsU B | 2102 |
| R-008381847-000K | 2398 | 151 | CCAGGAUGAUCCUAGCUAU | AuAGcuAGGAucAuccuGGUsU | 2030 |
| R-008381837-000T | 2398 | 151 | CCAGGAUGAUCCUAGCUAU | AuAGcuAGGAucAuccuGGUsU | 2030 |
| R-008381837-000T | 2398 | 151 | CCAGGAUGAUCCUAGCUAU | B CCAGgaUGaUCCUAgCUAUUsU B | 2104 |
| R-008381824-000Z | 2398 | 151 | CCAGGAUGAUCCUAGCUAU | B CCagGAUgAUCCUAGCUaUUsU B | 2107 |
| R-008381824-000Z | 2398 | 151 | CCAGGAUGAUCCUAGCUAU | AuAGcuAGGAucAuccuGGUsU | 2030 |
| R-008381810-000X | 2398 | 151 | CCAGGAUGAUCCUAGCUAU | B CCAGGAUGAUCCUAGCUaUUsU B | 2109 |
| R-008381810-000X | 2398 | 151 | CCAGGAUGAUCCUAGCUAU | AUAgCUaggaUCUCCUggUsU | 2036 |
| R-008381802-000X | 2398 | 151 | CCAGGAUGAUCCUAGCUAU | B cCAGgAUGAUCCUagCUAUUsU B | 2110 |
| R-008381802-000X | 2398 | 151 | CCAGGAUGAUCCUAGCUAU | AUAgCUaggaUCaUCCUggUsU | 2036 |
| R-008381820-000P | 2398 | 151 | CCAGGAUGAUCCUAGCUAU | AUAgCUaggaUCaUCCUggUsU | 2036 |
| R-008381820-000P | 2398 | 151 | CCAGGAUGAUCCUAGCUAU | B CCAGGAUGAUCCUAGCUAUUsU B | 2113 |
| R-008381819-000A | 2398 | 151 | CCAGGAUGAUCCUAGCUAU | AUAGCUAGGAUCAUCCUGGUsU | 2037 |
| R-008381819-000A | 2398 | 151 | CCAGGAUGAUCCUAGCUAU | B CCAGGAUGAUCCUAGCUaUUsU B | 2115 |
| R-008381787-000V | 2398 | 151 | CCAGGAUGAUCCUAGCUAU | AUAGCUAGGAUCAUCCUGGUsU | 2037 |
| R-008381787-000V | 2398 | 151 | CCAGGAUGAUCCUAGCUAU | B CCAgGAUgaUCCUaGCUAUUsU B | 2117 |
| R-008381835-000A | 2398 | 151 | CCAGGAUGAUCCUAGCUAU | B CCaggaUgaUCCUagCUaUUsU B | 2118 |
| R-008381835-000A | 2398 | 151 | CCAGGAUGAUCCUAGCUAU | AUAGCUAGGAUCAUCCUGGUsU | 2037 |
| R-008381844-000J | 2398 | 151 | CCAGGAUGAUCCUAGCUAU | AUAGCUAGGAUCAUCCUGGUsU | 2038 |
| R-008381844-000J | 2398 | 151 | CCAGGAUGAUCCUAGCUAU | B CCAGGAUGAUCCUAGCUAUUsU B | 2121 |
| R-008381853-000T | 2398 | 151 | CCAGGAUGAUCCUAGCUAU | B CCaGgaUGAUCCUAGcUAUUsU B | 2123 |
| R-008381853-000T | 2398 | 151 | CCAGGAUGAUCCUAGCUAU | AUAGCUAGGAUCAUCCUGGUsU | 2038 |
| R-008381833-000H | 2398 | 151 | CCAGGAUGAUCCUAGCUAU | B CCAGGaUGaUCCuAgCUAUUsU B | 2124 |
| R-008381833-000H | 2398 | 151 | CCAGGAUGAUCCUAGCUAU | AUAGCUAGGAUCAUCCUGGUsU | 2038 |
| R-008381817-000H | 2398 | 151 | CCAGGAUGAUCCUAGCUAU | AUAGcuAGGAucAuccuGGUsU | 2032 |
| R-008381817-000H | 2398 | 151 | CCAGGAUGAUCCUAGCUAU | B cCAGgaUGAUCCUAGcUAUUsU B | 2126 |
| R-008381786-000L | 2398 | 151 | CCAGGAUGAUCCUAGCUAU | AUAGcuAGGAucAuccuGGUsU | 2032 |
| R-008381786-000L | 2398 | 151 | CCAGGAUGAUCCUAGCUAU | B CCaGgAUgaUCCUAGCUaUUsU B | 2129 |
| R-008381851-000A | 2398 | 151 | CCAGGAUGAUCCUAGCUAU | AUAGcuAGGAucAuccuGGUsU | 2032 |
| R-008381851-000A | 2398 | 151 | CCAGGAUGAUCCUAGCUAU | B CcaggAugaUCCUAGCUaUUsU B | 2130 |
| R-008381809-000H | 2398 | 151 | CCAGGAUGAUCCUAGCUAU | AUAgCUaggaUCaUCCUGGUsU | 2039 |
| R-008381809-000H | 2398 | 151 | CCAGGAUGAUCCUAGCUAU | B CCAgGaUGAUcCUAGCUAUUsU B | 2133 |
| R-008381808-000Z | 2398 | 151 | CCAGGAUGAUCCUAGCUAU | B CCAggaUGAUCCUAgCUAUUsU B | 2135 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008381808-000Z | 2398 | 151 | CCAGGAUGAUCCUAGCUAU | AUAgCUaggaUCaUCCUggUsU | 2039 |
| R-008381784-000U | 2398 | 151 | CCAGGAUGAUCCUAGCUAU | AUAgCUaggaUCaUCCUggUsU | 2039 |
| R-008381784-000U | 2398 | 151 | CCAGGAUGAUCCUAGCUAU | B CCAGgAUgAUCCUAGcuaUUsU B | 2136 |
| R-008381793-000C | 1870 | 194 | ACGACUAGUUCAGUUGCUU | AAGcAAcuGAAcuAGucGuUsU | 2043 |
| R-008381793-000C | 1870 | 194 | ACGACUAGUUCAGUUGCUU | B ACgACuAgUUcAGUUGCUUUsU B | 2139 |
| R-008381807-000R | 1870 | 194 | ACGACUAGUUCAGUUGCUU | AAGcAAcuGAAcuAGucGuUsU | 2043 |
| R-008381807-000R | 1870 | 194 | ACGACUAGUUCAGUUGCUU | B aCGACUAGuUCAgUugcUUUsU B | 2141 |
| R-008381816-000Z | 1870 | 194 | ACGACUAGUUCAGUUGCUU | AAGcAAcuGAAcuAGucGuUsU | 2043 |
| R-008381816-000Z | 1870 | 194 | ACGACUAGUUCAGUUGCUU | B aCGACUagUUCaGUUgCUUUsU B | 2142 |
| R-008381830-000G | 1870 | 194 | ACGACUAGUUCAGUUGCUU | AAGCaaCUgaaCUagUCgUUsU | 2049 |
| R-008381830-000G | 1870 | 194 | ACGACUAGUUCAGUUGCUU | B aCgaCuAGUuCAgUUgcUUUsU B | 2145 |
| R-008381782-000B | 1870 | 194 | ACGACUAGUUCAGUUGCUU | B aCgaCUAguUCAGUUGCUUUsU B | 2147 |
| R-008381782-000B | 1870 | 194 | ACGACUAGUUCAGUUGCUU | AAGCaaCUgaaCUagUCgUUsU | 2049 |
| R-008381849-000C | 1870 | 194 | ACGACUAGUUCAGUUGCUU | B ACGACUaGUUCAGUUGCuUUsU B | 2148 |
| R-008381849-000C | 1870 | 194 | ACGACUAGUUCAGUUGCUU | AAGCaaCUgaaCUagUCgUUsU | 2049 |
| R-008381781-000T | 1870 | 194 | ACGACUAGUUCAGUUGCUU | B ACgACUAGUUCaGUUGcUUUsU B | 2150 |
| R-008381781-000T | 1870 | 194 | ACGACUAGUUCAGUUGCUU | AAGCAACUGAACUAGUCGUUsU | 2050 |
| R-008381829-000T | 1870 | 194 | ACGACUAGUUCAGUUGCUU | B acGACUagUUCagUuGCuUUsU B | 2152 |
| R-008381829-000T | 1870 | 194 | ACGACUAGUUCAGUUGCUU | AAGCAACUGAACUAGUCGUUsU | 2050 |
| R-008381792-000U | 1870 | 194 | ACGACUAGUUCAGUUGCUU | B aCGAcUAGUUCAGUUgCUUUsU B | 2154 |
| R-008381792-000U | 1870 | 194 | ACGACUAGUUCAGUUGCUU | AAGCAACUGAACUAGUCGUUsU | 2050 |
| R-008381798-000W | 1870 | 194 | ACGACUAGUUCAGUUGCUU | AAGCAACUGAACUAGUCGUUsU | 2051 |
| R-008381798-000W | 1870 | 194 | ACGACUAGUUCAGUUGCUU | B ACGACUaGUUCaGUUgCUUUsU B | 2156 |
| R-008381828-000J | 1870 | 194 | ACGACUAGUUCAGUUGCUU | AAGCAACUGAACUAGUCGUUsU | 2051 |
| R-008381828-000J | 1870 | 194 | ACGACUAGUUCAGUUGCUU | B ACGACUaGUUCAGUUGcUUUsU B | 2158 |
| R-008381840-000Z | 1870 | 194 | ACGACUAGUUCAGUUGCUU | AAGCAACUGAACUAGUCGUUsU | 2051 |
| R-008381840-000Z | 1870 | 194 | ACGACUAGUUCAGUUGCUU | B ACGACUAgUUCAgUUgCUUUsU B | 2161 |
| R-008381797-000M | 1870 | 194 | ACGACUAGUUCAGUUGCUU | B ACGACUaGuUCagUUGCUUUsU B | 2162 |
| R-008381797-000M | 1870 | 194 | ACGACUAGUUCAGUUGCUU | AAGcAAcuGAAcuAGucGuUsU | 2045 |
| R-008381813-000Y | 1870 | 194 | ACGACUAGUUCAGUUGCUU | B ACGaCUaGUUCaguUgCUuUsU B | 2165 |
| R-008381813-000Y | 1870 | 194 | ACGACUAGUUCAGUUGCUU | AAGcAAcuGAAcuAGucGuUsU | 2045 |
| R-008381827-000A | 1870 | 194 | ACGACUAGUUCAGUUGCUU | B ACGACUAGUUCAGUUGCUUUsU B | 2167 |
| R-008381827-000A | 1870 | 194 | ACGACUAGUUCAGUUGCUU | AAGcAAcuGAAcuAGucGuUsU | 2045 |
| R-008381812-000P | 1870 | 194 | ACGACUAGUUCAGUUGCUU | B aCgaCUAGUUCAGUUGCUUUsU B | 2169 |
| R-008381812-000P | 1870 | 194 | ACGACUAGUUCAGUUGCUU | AAGCaaCUgaaCUagUCgUUsU | 2052 |
| R-008381848-000U | 1870 | 194 | ACGACUAGUUCAGUUGCUU | B ACgAcUAgUuCAgUUGCUUUsU B | 2170 |
| R-008381848-000U | 1870 | 194 | ACGACUAGUUCAGUUGCUU | AAGCaaCUgaaCUagUCgUUsU | 2052 |
| R-008381779-000V | 1870 | 194 | ACGACUAGUUCAGUUGCUU | B aCgaCUagUUCagUUGcUUUsU B | 2173 |
| R-008381779-000V | 1870 | 194 | ACGACUAGUUCAGUUGCUU | AAGCaaCUgaaCUagUCgUUsU | 2052 |
| R-008381846-000B | 2401 | 196 | GGAUGAUCCUAGCUAUCGU | AcGAuAGcuAGGAucAuccUsU | 2056 |
| R-008381846-000B | 2401 | 196 | GGAUGAUCCUAGCUAUCGU | B gGaugaUcCUaGCuAUCgUUsU B | 2174 |
| R-008381811-000F | 2401 | 196 | GGAUGAUCCUAGCUAUCGU | B GgAUGaUCCuagcUAUCgUUsU B | 2177 |
| R-008381811-000F | 2401 | 196 | GGAUGAUCCUAGCUAUCGU | AcGAuAGcuAGGAucAuccUsU | 2056 |
| R-008381845-000T | 2401 | 196 | GGAUGAUCCUAGCUAUCGU | B gGAUgAUCCUAGcuaUCGUUsU B | 2179 |
| R-008381845-000T | 2401 | 196 | GGAUGAUCCUAGCUAUCGU | AcGAuAGcuAGGAucAuccUsU | 2056 |
| R-008381795-000V | 2401 | 196 | GGAUGAUCCUAGCUAUCGU | ACGAuUagCUaggaUCaUCCUsU | 2062 |
| R-008381795-000V | 2401 | 196 | GGAUGAUCCUAGCUAUCGU | B gGAUGAUCCUAgCUauCGUUsU B | 2181 |
| R-008381823-000R | 2401 | 196 | GGAUGAUCCUAGCUAUCGU | ACGAUagCUaggaUCaUCCUsU | 2062 |
| R-008381823-000R | 2401 | 196 | GGAUGAUCCUAGCUAUCGU | B ggaUgaUCCUagCUaUCgUUsU B | 2182 |
| R-008381803-000F | 2401 | 196 | GGAUGAUCCUAGCUAUCGU | ACGAUagCUaggaUCaUCCUsU | 2062 |
| R-008381803-000F | 2401 | 196 | GGAUGAUCCUAGCUAUCGU | B GGAUGAUCCUAGCUaUCgUUsU B | 2185 |
| R-008381822-000G | 2401 | 196 | GGAUGAUCCUAGCUAUCGU | B GGaUGAUCCUaGCUAUCgUUsU B | 2187 |
| R-008381822-000G | 2401 | 196 | GGAUGAUCCUAGCUAUCGU | ACGAUAGCUAGGAUCAUCCUsU | 2063 |
| R-008381836-000J | 2401 | 196 | GGAUGAUCCUAGCUAUCGU | B gGaUgAUCCUaGCUAUCgUUsU B | 2188 |
| R-008381836-000J | 2401 | 196 | GGAUGAUCCUAGCUAUCGU | ACGAUAGCUAGGAUCAUCCUsU | 2063 |
| R-008381854-000B | 2401 | 196 | GGAUGAUCCUAGCUAUCGU | B GgAUGauCCUAGCUAUCgUUsU B | 2191 |
| R-008381854-000B | 2401 | 196 | GGAUGAUCCUAGCUAUCGU | ACGAUAGCUAGGAUCAUCCUsU | 2063 |
| R-008381801-000N | 2401 | 196 | GGAUGAUCCUAGCUAUCGU | B GgaUgAUCcUagCUaUCGUUsU B | 2192 |
| R-008381801-000N | 2401 | 196 | GGAUGAUCCUAGCUAUCGU | ACGAUAGCUAGGAUCAUCCUsU | 2064 |
| R-008381800-000E | 2401 | 196 | GGAUGAUCCUAGCUAUCGU | B GGaUGaUCCuAGcUAUcgUUsU B | 2194 |
| R-008381800-000E | 2401 | 196 | GGAUGAUCCUAGCUAUCGU | ACGAUAGCUAGGAUCAUCCUsU | 2064 |
| R-008381834-000S | 2401 | 196 | GGAUGAUCCUAGCUAUCGU | B GgAUGAUCCuagCUAUCgUUsU B | 2197 |
| R-008381834-000S | 2401 | 196 | GGAUGAUCCUAGCUAUCGU | ACGAUAGCUAGGAUCAUCCUsU | 2064 |
| R-008381852-000J | 2401 | 196 | GGAUGAUCCUAGCUAUCGU | ACGAuAuGcuAGGAucAuccUsU | 2058 |
| R-008381852-000J | 2401 | 196 | GGAUGAUCCUAGCUAUCGU | B GGAUGAuCCUAGCUAUCgUUsU B | 2199 |
| R-008381843-000A | 2401 | 196 | GGAUGAUCCUAGCUAUCGU | ACGAuAGcuAGGAucAuccUsU | 2058 |
| R-008381843-000A | 2401 | 196 | GGAUGAUCCUAGCUAUCGU | B GgaUgaUCCUAgCUAUCGUUsU B | 2201 |
| R-008381832-000Z | 2401 | 196 | GGAUGAUCCUAGCUAUCGU | ACGAUAGcuAGGAUcAuccUsU | 2058 |
| R-008381832-000Z | 2401 | 196 | GGAUGAUCCUAGCUAUCGU | B GGAUgAUCCUAgcUAUCgUUsU B | 2203 |
| R-008381818-000S | 2401 | 196 | GGAUGAUCCUAGCUAUCGU | B GGAUgaUCCuAGcUAUCgUUsU B | 2204 |
| R-008381818-000S | 2401 | 196 | GGAUGAUCCUAGCUAUCGU | ACGAUagCUaggaUCaUCCUsU | 2065 |
| R-008381785-000C | 2401 | 196 | GGAUGAUCCUAGCUAUCGU | B GGAUGAUCCUagCUAUCGUUsU B | 2206 |
| R-008381785-000C | 2401 | 196 | GGAUGAUCCUAGCUAUCGU | ACGaUagCUaggaUCaUCCUsU | 2065 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008381794-000L | 2401 | 196 | GGAUGAUCCUAGCUAUCGU | ACGaUagCUaggaUCaUCCUsU | 2065 |
| R-008381794-000L | 2401 | 196 | GGAUGAUCCUAGCUAUCGU | B gGAUgaUCCUAGCUaUCGUUsU B | 2208 |
| R-008395187-000D | 1797 | 5 | CUGUUGGAUUGAUUCGAAA | B cuGuuGGAuuGAuucGAAATT B | 2210 |
| R-008395187-000D | 1797 | 5 | CUGUUGGAUUGAUUCGAAA | UUUcGAAucAAuccAAcAGUU | 1463 |
| R-008395244-000T | 1797 | 5 | CUGUUGGAUUGAUUCGAAA | B cuGuuGGAuuGAuucGAAATT B | 2210 |
| R-008395244-000T | 1797 | 5 | CUGUUGGAUUGAUUCGAAA | IUUcGAAucAAuccAAcAGUU | 2211 |
| R-008395198-000E | 1797 | 5 | CUGUUGGAUUGAUUCGAAA | UIUcGAAucAAuccAAcAGUU | 2212 |
| R-008395198-000E | 1797 | 5 | CUGUUGGAUUGAUUCGAAA | B cuGuuGGAuuGAuucGAAATT B | 2210 |
| R-008395222-000R | 1797 | 5 | CUGUUGGAUUGAUUCGAAA | UUIcGAAucAAuccAAcAGUU | 2213 |
| R-008395222-000R | 1797 | 5 | CUGUUGGAUUGAUUCGAAA | B cuGuuGGAuuGAuucGAAATT B | 2210 |
| R-008395155-000J | 1797 | 5 | CUGUUGGAUUGAUUCGAAA | B cuGuuGGAuuGAuucGAAATT B | 2210 |
| R-008395155-000J | 1797 | 5 | CUGUUGGAUUGAUUCGAAA | UUUIGAAucAAuccAAcAGUU | 2214 |
| R-008395242-000A | 1797 | 5 | CUGUUGGAUUGAUUCGAAA | B cuGuuGGAuuGAuucGAAATT B | 2210 |
| R-008395242-000A | 1797 | 5 | CUGUUGGAUUGAUUCGAAA | UUUcIAAucAAuccAAcAGUU | 2215 |
| R-008395267-000D | 1797 | 5 | CUGUUGGAUUGAUUCGAAA | B cuGuuGGAuuGAuucGAAATT B | 2210 |
| R-008395267-000D | 1797 | 5 | CUGUUGGAUUGAUUCGAAA | UUUcGIAucAAuccAAcAGUU | 2216 |
| R-008395153-000S | 1797 | 5 | CUGUUGGAUUGAUUCGAAA | B cuGuuGGAuuGAuucGAAATT B | 2210 |
| R-008395153-000S | 1797 | 5 | CUGUUGGAUUGAUUCGAAA | UUUcGAIucAAuccAAcAGUU | 2217 |
| R-008395286-000E | 1797 | 5 | CUGUUGGAUUGAUUCGAAA | B cuGuuGGAuuGAuucGAAATT B | 2210 |
| R-008395286-000E | 1797 | 5 | CUGUUGGAUUGAUUCGAAA | UUUcGAAIcAAuccAAcAGUU | 2218 |
| R-008395196-000M | 1870 | 194 | ACGACUAGUUCAGUUGCUU | B AcGAcuAGuucAGuuGcuuTT B | 2219 |
| R-008395196-000M | 1870 | 194 | ACGACUAGUUCAGUUGCUU | AAGcAAcuGAAcuAGucGuUU | 1841 |
| R-008395168-000C | 1870 | 194 | ACGACUAGUUCAGUUGCUU | IAGcAAcuGAAcuAGucGuUU | 2220 |
| R-008395168-000C | 1870 | 194 | ACGACUAGUUCAGUUGCUU | B AcGAcuAGuucAGuuGcuuTT B | 2219 |
| R-008395265-000L | 1870 | 194 | ACGACUAGUUCAGUUGCUU | AIGcAAcuGAAcuAGucGuUU | 2221 |
| R-008395265-000L | 1870 | 194 | ACGACUAGUUCAGUUGCUU | B AcGAcuAGuucAGuuGcuuTT B | 2219 |
| R-008395150-000R | 1870 | 194 | ACGACUAGUUCAGUUGCUU | AAIcAAcuGAAcuAGucGuUU | 2222 |
| R-008395150-000R | 1870 | 194 | ACGACUAGUUCAGUUGCUU | B AcGAcuAGuucAGuuGcuuTT B | 2219 |
| R-008395263-000U | 1870 | 194 | ACGACUAGUUCAGUUGCUU | B AcGAcuAGuucAGuuGcuuTT B | 2219 |
| R-008395263-000U | 1870 | 194 | ACGACUAGUUCAGUUGCUU | AAGIAAcuGAAcuAGucGuUU | 2223 |
| R-008395172-000T | 1870 | 194 | ACGACUAGUUCAGUUGCUU | AAGcIAcuGAAcuAGucGuUU | 2224 |
| R-008395172-000T | 1870 | 194 | ACGACUAGUUCAGUUGCUU | B AcGAcuAGuucAGuuGcuuTT B | 2219 |
| R-008395170-000A | 1870 | 194 | ACGACUAGUUCAGUUGCUU | B AcGAcuAGuucAGuuGcuuTT B | 2219 |
| R-008395170-000A | 1870 | 194 | ACGACUAGUUCAGUUGCUU | AAGcAIcuGAAcuAGucGuUU | 2225 |
| R-008395226-000A | 1870 | 194 | ACGACUAGUUCAGUUGCUU | B AcGAcuAGuucAGuuGcuuTT B | 2219 |
| R-008395226-000A | 1870 | 194 | ACGACUAGUUCAGUUGCUU | AAGcAAIuGAAcuAGucGuUU | 2226 |
| R-008395207-000Z | 1870 | 194 | ACGACUAGUUCAGUUGCUU | AAGcAAcIGAAcuAGucGuUU | 2227 |
| R-008395207-000Z | 1870 | 194 | ACGACUAGUUCAGUUGCUU | B AcGAcuAGuucAGuuGcuuTT B | 2219 |
| R-008395205-000G | 2398 | 151 | CCAGGAUGAUCCUAGCUAU | AUAGcuAGGAucAuccuGGUU | 1755 |
| R-008395205-000G | 2398 | 151 | CCAGGAUGAUCCUAGCUAU | B ccAGGAuGAuccuAGcuAuTT B | 2228 |
| R-008395250-000A | 2398 | 151 | CCAGGAUGAUCCUAGCUAU | B ccAGGAuGAuccuAGcuAuTT B | 2228 |
| R-008395250-000A | 2398 | 151 | CCAGGAUGAUCCUAGCUAU | IUAGcuAGGAucAuccuGGUU | 2229 |
| R-008395248-000C | 2398 | 151 | CCAGGAUGAUCCUAGCUAU | B ccAGGAuGAuccuAGcuAuTT B | 2228 |
| R-008395248-000C | 2398 | 151 | CCAGGAUGAUCCUAGCUAU | AIAGcuAGGAucAuccuGGUU | 2230 |
| R-008395275-000D | 2398 | 151 | CCAGGAUGAUCCUAGCUAU | AUIGcuAGGAucAuccuGGUU | 2231 |
| R-008395275-000D | 2398 | 151 | CCAGGAUGAUCCUAGCUAU | B ccAGGAuGAuccuAGcuAuTT B | 2228 |
| R-008395163-000J | 2398 | 151 | CCAGGAUGAUCCUAGCUAU | AUAIcuAGGAucAuccuGGUU | 2232 |
| R-008395163-000J | 2398 | 151 | CCAGGAUGAUCCUAGCUAU | B ccAGGAuGAuccuAGcuAuTT B | 2228 |
| R-008395224-000H | 2398 | 151 | CCAGGAUGAUCCUAGCUAU | B ccAGGAuGAuccuAGcuAuTT B | 2228 |
| R-008395224-000H | 2398 | 151 | CCAGGAUGAUCCUAGCUAU | AUAGIuAGGAucAuccuGGUU | 2233 |
| R-008395161-000S | 2398 | 151 | CCAGGAUGAUCCUAGCUAU | AUAGcIAGGAucAuccuGGUU | 2234 |
| R-008395161-000S | 2398 | 151 | CCAGGAUGAUCCUAGCUAU | B ccAGGAuGAuccuAGcuAuTT B | 2228 |
| R-008395290-000V | 2398 | 151 | CCAGGAUGAUCCUAGCUAU | B ccAGGAuGAuccuAGcuAuTT B | 2228 |
| R-008395290-000V | 2398 | 151 | CCAGGAUGAUCCUAGCUAU | AUAGcuIGGAucAuccuGGUU | 2235 |
| R-008395273-000L | 2398 | 151 | CCAGGAUGAUCCUAGCUAU | B ccAGGAuGAuccuAGcuAuTT B | 2228 |
| R-008395273-000L | 2398 | 151 | CCAGGAUGAUCCUAGCUAU | AUAGcuAIGAucAuccuGGUU | 2236 |
| R-008395188-000M | 2401 | 196 | GGAUGAUCCUAGCUAUCGU | ACGAuAGcuAGGAucAuccUU | 1845 |
| R-008395188-000M | 2401 | 196 | GGAUGAUCCUAGCUAUCGU | B GGAuGAuccuAGcuAucGuTT B | 2237 |
| R-008395204-000Y | 2401 | 196 | GGAUGAUCCUAGCUAUCGU | ICGAuAGcuAGGAucAuccUU | 2238 |
| R-008395204-000Y | 2401 | 196 | GGAUGAUCCUAGCUAUCGU | B GGAuGAuccuAGcuAucGuTT B | 2237 |
| R-008395202-000F | 2401 | 196 | GGAUGAUCCUAGCUAUCGU | AIGAuAGcuAGGAucAuccUU | 2239 |
| R-008395202-000F | 2401 | 196 | GGAUGAUCCUAGCUAUCGU | B GGAuGAuccuAGcuAucGuTT B | 2237 |
| R-008395158-000K | 2401 | 196 | GGAUGAUCCUAGCUAUCGU | ACIAuAGcuAGGAucAuccUU | 2240 |
| R-008395158-000K | 2401 | 196 | GGAUGAUCCUAGCUAUCGU | B GGAuGAuccuAGcuAucGuTT B | 2237 |
| R-008395246-000K | 2401 | 196 | GGAUGAUCCUAGCUAUCGU | ACGIuAGcuAGGAucAuccUU | 2241 |
| R-008395246-000K | 2401 | 196 | GGAUGAUCCUAGCUAUCGU | B GGAuGAuccuAGcuAucGuTT B | 2237 |
| R-008395271-000U | 2401 | 196 | GGAUGAUCCUAGCUAUCGU | B GGAuGAuccuAGcuAucGuTT B | 2237 |
| R-008395271-000U | 2401 | 196 | GGAUGAUCCUAGCUAUCGU | ACGAIAGcuAGGAucAuccUU | 2242 |
| R-008395200-000N | 2401 | 196 | GGAUGAUCCUAGCUAUCGU | ACGAuIGcuAGGAucAuccUU | 2243 |
| R-008395200-000N | 2401 | 196 | GGAUGAUCCUAGCUAUCGU | B GGAuGAuccuAGcuAucGuTT B | 2237 |
| R-008395288-000X | 2401 | 196 | GGAUGAUCCUAGCUAUCGU | B GGAuGAuccuAGcuAucGuTT B | 2237 |
| R-008395288-000X | 2401 | 196 | GGAUGAUCCUAGCUAUCGU | ACGAuAIcuAGGAucAuccUU | 2244 |
| R-008395269-000W | 2401 | 196 | GGAUGAUCCUAGCUAUCGU | ACGAuAGIuAGGAucAuccUU | 2245 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008395269-000W | 2401 | 196 | GGAUGAUCCUAGCUAUCGU | B GGAuGAuccuAGcuAucGuTT B | 2237 |
| R-008397891-000B | 1382 | 238 | GAUCCAAGUCAACGUCUUG | B GAUCCAAGUCAACGUCUUGTT B | 2246 |
| R-008397891-000B | 1382 | 238 | GAUCCAAGUCAACGUCUUG | CAAGACGUUGACUUGGAUCUU | 2247 |
| R-008397894-000C | 828 | 239 | CUAUCAUGCGUUCUCCUCA | B CUAUCAUGCGUUCUCCUCATT B | 2248 |
| R-008397894-000C | 828 | 239 | CUAUCAUGCGUUCUCCUCA | UGAGGAGAACGCAUGAUAGUU | 2249 |
| R-008396925-000E | 1244 | 240 | AAUAUAAUGAGGACCUAUA | B AAUAUAAUGAGGACCUAUATT B | 2250 |
| R-008396925-000E | 1244 | 240 | AAUAUAAUGAGGACCUAUA | UAUAGGUCCUCAUUAUAUUUU | 2251 |
| R-008395941-000K | 1304 | 241 | GUGCUAUCUGUCUGCUCUA | B GUGCUAUCUGUCUGCUCUATT B | 2252 |
| R-008395941-000K | 1304 | 241 | GUGCUAUCUGUCUGCUCUA | UAGAGCAGACAGAUAGCACUU | 2253 |
| R-008395944-000L | 812 | 242 | GAAGCUUCCAGACACGCUA | B GAAGCUUCCAGACACGCUATT B | 2254 |
| R-008395944-000L | 812 | 242 | GAAGCUUCCAGACACGCUA | UAGCGUGUCUGGAAGCUUCUU | 2255 |
| R-008397498-000Y | 1558 | 243 | UAAUUAUAAGAACAAGAUG | B UAAUUAUAAGAACAAGAUGTT B | 2256 |
| R-008397498-000Y | 1558 | 243 | UAAUUAUAAGAACAAGAUG | CAUCUUGUUCUUAUAAUUAUU | 2257 |
| R-008397501-000R | 879 | 244 | AUACAAAUGAUGUAGAAAC | B AUACAAAUGAUGUAGAAACTT B | 2258 |
| R-008397501-000R | 879 | 244 | AUACAAAUGAUGUAGAAAC | GUUUCUACAUCAUUUGUAUUU | 2259 |
| R-008396451-000Y | 1311 | 245 | CUGUCUGCUCUAGUAAUAA | UUAUUACUAGAGCAGACAGUU | 2261 |
| R-008396451-000Y | 1311 | 245 | CUGUCUGCUCUAGUAAUAA | B CUGUCUGCUCUAGUAAUAATT B | 2260 |
| R-008397504-000S | 856 | 246 | UGCUAUUGUACGUACCAUG | B UGCUAUUGUACGUACCAUGTT B | 2262 |
| R-008397504-000S | 856 | 246 | UGCUAUUGUACGUACCAUG | CAUGGUACGUACAAUAGCAUU | 2263 |
| R-008396961-000P | 1296 | 247 | UGCUGAAGGUGCUAUCUGU | B UGCUGAAGGUGCUAUCUGUTT B | 2264 |
| R-008396961-000P | 1296 | 247 | UGCUGAAGGUGCUAUCUGU | ACAGAUAGCACCUUCAGCAUU | 2265 |
| R-008396967-000S | 1235 | 39 | GCUUUAGUAAAUAUAAUGA | B GCUUUAGUAAAUAUAAUGATT B | 2266 |
| R-008396967-000S | 1235 | 39 | GCUUUAGUAAAUAUAAUGA | UCAUUAUAUUUACUAAAGCUU | 2267 |
| R-008396463-000H | 960 | 248 | UCUUUAAGUCUGGAGGCAU | AUGCCUCCAGACUUAAAGAUU | 2269 |
| R-008396463-000H | 960 | 248 | UCUUUAAGUCUGGAGGCAU | B UCUUUAAGUCUGGAGGCAUTT B | 2268 |
| R-008398998-000S | 2049 | 249 | AUACCAUUCCAUUGUUUGU | B AUACCAUUCCAUUGUUUGUTT B | 2270 |
| R-008398998-000S | 2049 | 249 | AUACCAUUCCAUUGUUUGU | ACAACAAUGGAAUGGUAUUU | 2271 |
| R-008398515-000M | 1791 | 250 | AGGCUACUGUUGGAUUGAU | AUCAAUCCAACAGUAGCCUU | 2273 |
| R-008398515-000M | 1791 | 250 | AGGCUACUGUUGGAUUGAU | B AGGCUACUGUUGGAUUGAUTT B | 2272 |
| R-008395947-000M | 783 | 251 | CAGUUAUGGUCCAUCAGCU | B CAGUUAUGGUCCAUCAGCUTT B | 2274 |
| R-008395947-000M | 783 | 251 | CAGUUAUGGUCCAUCAGCU | AGCUGAUGGACCAUAACUGUU | 2275 |
| R-008396466-000J | 1569 | 252 | ACAAGAUGAUGGUCUGCCA | B ACAAGAUGAUGGUCUGCCATT B | 2276 |
| R-008396466-000J | 1569 | 252 | ACAAGAUGAUGGUCUGCCA | UGGCAGACCAUCAUCUUGUUU | 2277 |
| R-008396970-000Y | 2224 | 253 | GACAUAUGCAGCUGCUGUU | AACAGCAGCUGCAUAUGUCUU | 2279 |
| R-008396970-000Y | 2224 | 253 | GACAUAUGCAGCUGCUGUU | B GACAUAUGCAGCUGCUGUUTT B | 2278 |
| R-008395989-000Z | 1882 | 123 | GUUGCUUGUUCGUGCACAU | B GUUGCUUGUUCGUGCACAUTT B | 2280 |
| R-008395989-000Z | 1882 | 123 | GUUGCUUGUUCGUGCACAU | AUGUGCACGAACAAGCAACUU | 2281 |
| R-008398626-000Y | 934 | 254 | CCAUCAUCGUGAGGGCUUA | B CCAUCAUCGUGAGGGCUUATT B | 2282 |
| R-008398626-000Y | 934 | 254 | CCAUCAUCGUGAGGGCUUA | UAAGCCCUCACGAUGAUGGUU | 2283 |
| R-008396121-000S | 1378 | 255 | GACAGAUCCAAGUCAACGU | B GACAGAUCCAAGUCAACGUTT B | 2284 |
| R-008396121-000S | 1378 | 255 | GACAGAUCCAAGUCAACGU | ACGUUGACUUGGAUCUGUCUU | 2285 |
| R-008396001-000X | 569 | 256 | GAGACAUUAGAUGAGGGCA | UGCCCUCAUCUAAUGUCUCUU | 2287 |
| R-008396001-000X | 569 | 256 | GAGACAUUAGAUGAGGGCA | B GAGACAUUAGAUGAGGGCATT B | 2286 |
| R-008396007-000Z | 1722 | 257 | UUCGCCUUCACUAUGGACU | B UUCGCCUUCACUAUGGACUTT B | 2288 |
| R-008396007-000Z | 1722 | 257 | UUCGCCUUCACUAUGGACU | AGUCCAUAGUGAAGGCGAAUU | 2289 |
| R-008396547-000T | 1483 | 258 | UGUUCAGCUUCUGGGUUCA | B UGUUCAGCUUCUGGGUUCATT B | 2290 |
| R-008396547-000T | 1483 | 258 | UGUUCAGCUUCUGGGUUCA | UGAACCCAGAAGCUGAACUUU | 2291 |
| R-008399088-000F | 2352 | 259 | AUCUUGGACUUGAUAUUGG | CCAAUAUCAAGUCCAAGAUUU | 2293 |
| R-008399088-000F | 2352 | 259 | AUCUUGGACUUGAUAUUGG | B AUCUUGGACUUGAUAUUGGTT B | 2292 |
| R-008398596-000K | 719 | 260 | CGUGCAAUCCCUGAACUGA | B CGUGCAAUCCCUGAACUGATT B | 2294 |
| R-008398596-000K | 719 | 260 | CGUGCAAUCCCUGAACUGA | UCAGUUCAGGGAUUGCACGUU | 2295 |
| R-008399094-000N | 762 | 261 | AGGUGGUGGUUAAUAAGGC | B AGGUGGUGGUUAAUAAGGCTT B | 2296 |
| R-008399094-000N | 762 | 261 | AGGUGGUGGUUAAUAAGGC | GCCUUAUUAACCACCACCUUU | 2297 |
| R-008397585-000P | 599 | 262 | UCUACACAGUUUGAUGCUG | B UCUACACAGUUUGAUGCUGTT B | 2298 |
| R-008397585-000P | 599 | 262 | UCUACACAGUUUGAUGCUG | CAGCAUCAAACUGUGUAGAUU | 2299 |
| R-008396073-000L | 1704 | 263 | AGAUGGCCCAGAAUGCAGU | B AGAUGGCCCAGAAUGCAGUTT B | 2300 |
| R-008396073-000L | 1704 | 263 | AGAUGGCCCAGAAUGCAGU | ACUGCAUUCUGGGCCAUCUUU | 2301 |
| R-008398599-000L | 2270 | 264 | CAAGAUUACAAGAAACGGC | GCCGUUUCUUGUAAUCUUGUU | 2303 |
| R-008398599-000L | 2270 | 264 | CAAGAUUACAAGAAACGGC | B CAAGAUUACAAGAAACGGCTT B | 2302 |
| R-008399532-000R | 1810 | 103 | UCGAAAUCUUGCCCUUUGU | ACAAAGGGCAAGAUUUCGAUU | 2305 |
| R-008399532-000R | 1810 | 103 | UCGAAAUCUUGCCCUUUGU | B UCGAAAUCUUGCCCUUUGUTT B | 2304 |
| R-008398602-000D | 662 | 265 | CUGAAACAUGCAGUUGUAA | B CUGAAACAUGCAGUUGUAATT B | 2306 |
| R-008398602-000D | 662 | 265 | CUGAAACAUGCAGUUGUAA | UUACAACUGCAUGUUUCAGUU | 2307 |
| R-008399106-000J | 396 | 266 | CUCCUUCUCUGAGUGGUAA | UUACCACUCAGAGAAGGAGUU | 2309 |
| R-008399106-000J | 396 | 266 | CUCCUUCUCUGAGUGGUAA | B CUCCUUCUCUGAGUGGUAATT B | 2308 |
| R-008398053-000R | 1199 | 267 | AGCAAGCUCAUCAUACUGG | CCAGUAUGAUGAGCUUGCUUU | 2311 |
| R-008398053-000R | 1199 | 267 | AGCAAGCUCAUCAUACUGG | B AGCAAGCUCAUCAUACUGGTT B | 2310 |
| R-008396583-000C | 1560 | 268 | AUUAUAAGAACAAGAUGAU | B AUUAUAAGAACAAGAUGAUTT B | 2312 |
| R-008396583-000C | 1560 | 268 | AUUAUAAGAACAAGAUGAU | AUCAUCUUGUUCUUAUAAUUU | 2313 |
| R-008399028-000B | 593 | 92 | AUCCCAUCUACACAGUUUG | CAAACUGUGUAGAUGGGAUUU | 2315 |
| R-008399028-000B | 593 | 92 | AUCCCAUCUACACAGUUUG | B AUCCCAUCUACACAGUUUGTT B | 2314 |
| R-008398104-000X | 1310 | 269 | UCUGUCUGCUCUAGUAAUA | B UCUGUCUGCUCUAGUAAUATT B | 2316 |
| R-008398104-000X | 1310 | 269 | UCUGUCUGCUCUAGUAAUA | UAUUACUAGAGCAGACAGAUU | 2317 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398113-000F | 1233 | 270 | AAGCUUUAGUAAAUAUAAU | B AAGCUUUAGUAAAUAUAAUTT B | 2318 |
| R-008398113-000F | 1233 | 270 | AAGCUUUAGUAAAUAUAAU | AUUAUAUUUACUAAAGCUUUU | 2319 |
| R-008399622-000H | 1330 | 271 | GCCGGCUAUUGUAGAAGCU | B GCCGGCUAUUGUAGAAGCUTT B | 2320 |
| R-008399622-000H | 1330 | 271 | GCCGGCUAUUGUAGAAGCU | AGCUUCUACAAUAGCCGGCUU | 2321 |
| R-008399151-000C | 1312 | 272 | UGUCUGCUCUAGUAAUAAG | B UGUCUGCUCUAGUAAUAAGTT B | 2322 |
| R-008399151-000C | 1312 | 272 | UGUCUGCUCUAGUAAUAAG | CUUAUUACUAGAGCAGACAUU | 2323 |
| R-008396127-000U | 1556 | 273 | AAUAAUUAUAAGAACAAGA | UCUUGUUCUUAUAAUUAUUUU | 2325 |
| R-008396127-000U | 1556 | 273 | AAUAAUUAUAAGAACAAGA | B AAUAAUUAUAAGAACAAGATT B | 2324 |
| R-008395707-000Y | 2438 | 274 | UAUGGCCAGGAUGCCUUGG | B UAUGGCCAGGAUGCCUUGGTT B | 2326 |
| R-008395707-000Y | 2438 | 274 | UAUGGCCAGGAUGCCUUGG | CCAAGGCAUCCUGGCCAUAUU | 2327 |
| R-008395710-000E | 1826 | 275 | UGUCCCGCAAAUCAUGCAC | GUGCAUGAUUUGCGGGACAUU | 2329 |
| R-008395710-000E | 1826 | 275 | UGUCCCGCAAAUCAUGCAC | B UGUCCCGCAAAUCAUGCACTT B | 2328 |
| R-008395713-000F | 1397 | 276 | CUUGUUCAGAACUGUCUUU | B CUUGUUCAGAACUGUCUUUTT B | 2330 |
| R-008395713-000F | 1397 | 276 | CUUGUUCAGAACUGUCUUU | AAAGACAGUUCUGAACAAGUU | 2331 |
| R-008395716-000G | 3181 | 277 | GCUGUGAUACGAUGCUUCA | UGAAGCAUCGUAUCACAGCUU | 2333 |
| R-008395716-000G | 3181 | 277 | GCUGUGAUACGAUGCUUCA | B GCUGUGAUACGAUGCUUCATT B | 2332 |
| R-008395719-000H | 1912 | 278 | GCGCCGUACGUCCAUGGGU | B GCGCCGUACGUCCAUGGGUTT B | 2334 |
| R-008395719-000H | 1912 | 278 | GCGCCGUACGUCCAUGGGU | ACCCAUGGACGUACGGCGCUU | 2335 |
| R-008395722-000P | 846 | 279 | AGAUGGUGUCUGCUAUUGU | B AGAUGGUGUCUGCUAUUGUTT B | 2336 |
| R-008395722-000P | 846 | 279 | AGAUGGUGUCUGCUAUUGU | ACAAUAGCAGACACCAUCUUU | 2337 |
| R-008395725-000R | 1404 | 280 | AGAACUGUCUUUGGACUCU | B AGAACUGUCUUUGGACUCUTT B | 2338 |
| R-008395725-000R | 1404 | 280 | AGAACUGUCUUUGGACUCU | AGAGUCCAAAGACAGUUCUUU | 2339 |
| R-008395728-000S | 586 | 281 | CAUGCAGAUCCCAUCUACA | UGUAGAUGGGAUCUGCAUGUU | 2341 |
| R-008395728-000S | 586 | 281 | CAUGCAGAUCCCAUCUACA | B CAUGCAGAUCCCAUCUACATT B | 2340 |
| R-008395731-000Y | 1469 | 282 | CUCCUUGGGACUCUUGUUC | GAACAAGAGUCCCAAGGAGUU | 2343 |
| R-008395731-000Y | 1469 | 282 | CUCCUUGGGACUCUUGUUC | B CUCCUUGGGACUCUUGUUCTT B | 2342 |
| R-008395734-000Z | 380 | 283 | GGUGCCACUACCACAGCUC | B GGUGCCACUACCACAGCUCTT B | 2344 |
| R-008395734-000Z | 380 | 283 | GGUGCCACUACCACAGCUC | GAGCUGUGGUAGUGGCACCUU | 2345 |
| R-008395737-000A | 1345 | 284 | AGCUGGUGGAAUGCAAGCU | B AGCUGGUGGAAUGCAAGCUTT B | 2346 |
| R-008395737-000A | 1345 | 284 | AGCUGGUGGAAUGCAAGCU | AGCUUGCAUUCCACCAGCUUU | 2347 |
| R-008395740-000G | 1863 | 285 | CCAUUCCACGACUAGUUCA | B CCAUUCCACGACUAGUUCATT B | 2348 |
| R-008395740-000G | 1863 | 285 | CCAUUCCACGACUAGUUCA | UGAACUAGUCGUGGAAUGGUU | 2349 |
| R-008395743-000H | 635 | 286 | CAGCGUUUGGCUGAACCAU | AUGGUUCAGCCAAACGCUGUU | 2351 |
| R-008395743-000H | 635 | 286 | CAGCGUUUGGCUGAACCAU | B CAGCGUUUGGCUGAACCAUTT B | 2350 |
| R-008395746-000J | 959 | 287 | AUCUUUAAGUCUGGAGGCA | UGCCUCCAGACUUAAAGAUUU | 2353 |
| R-008395746-000J | 959 | 287 | AUCUUUAAGUCUGGAGGCA | B AUCUUUAAGUCUGGAGGCATT B | 2352 |
| R-008395749-000K | 2440 | 288 | UGGCCAGGAUGCCUUGGGU | B UGGCCAGGAUGCCUUGGGUTT B | 2354 |
| R-008395749-000K | 2440 | 288 | UGGCCAGGAUGCCUUGGGU | ACCCAAGGCAUCCUGGCCAUU | 2355 |
| R-008395752-000S | 877 | 289 | GAAUACAAAUGAUGUAGAA | UUCUACAUCAUUUGUAUUCUU | 2357 |
| R-008395752-000S | 877 | 289 | GAAUACAAAUGAUGUAGAA | B GAAUACAAAUGAUGUAGAATT B | 2356 |
| R-008395755-000T | 2556 | 290 | UGGAUGGGCUGCCUCCAGG | CCUGGAGGCAGCCCAUCCAUU | 2359 |
| R-008395755-000T | 2556 | 290 | UGGAUGGGCUGCCUCCAGG | B UGGAUGGGCUGCCUCCAGGTT B | 2358 |
| R-008395758-000U | 1916 | 291 | CGUACGUCCAUGGGUGGGA | B CGUACGUCCAUGGGUGGGATT B | 2360 |
| R-008395758-000U | 1916 | 291 | CGUACGUCCAUGGGUGGGA | UCCCACCCAUGGACGUACGUU | 2361 |
| R-008395761-000A | 850 | 292 | GGUGUCUGCUAUUGUACGU | B GGUGUCUGCUAUUGUACGUTT B | 2362 |
| R-008395761-000A | 850 | 292 | GGUGUCUGCUAUUGUACGU | ACGUACAAUAGCAGACACCUU | 2363 |
| R-008395764-000B | 1303 | 293 | GGUGCUAUCUGUCUGCUCU | B GGUGCUAUCUGUCUGCUCUTT B | 2364 |
| R-008395764-000B | 1303 | 293 | GGUGCUAUCUGUCUGCUCU | AGAGCAGACAGAUAGCACCUU | 2365 |
| R-008395767-000C | 1726 | 294 | CCUUCACUAUGGACUACCA | UGGUAGUCCAUAGUGAAGGUU | 2367 |
| R-008395767-000C | 1726 | 294 | CCUUCACUAUGGACUACCA | B CCUUCACUAUGGACUACCATT B | 2366 |
| R-008395770-000J | 1477 | 295 | GACUCUUGUUCAGCUUCUG | CAGAAGCUGAACAAGAGUCUU | 2369 |
| R-008395770-000J | 1477 | 295 | GACUCUUGUUCAGCUUCUG | B GACUCUUGUUCAGCUUCUGTT B | 2368 |
| R-008395773-000K | 598 | 296 | AUCUACACAGUUUGAUGCU | B AUCUACACAGUUUGAUGCUTT B | 2370 |
| R-008395773-000K | 598 | 296 | AUCUACACAGUUUGAUGCU | AGCAUCAAACUGUGUAGAUUU | 2371 |
| R-008395776-000L | 2062 | 297 | GUUUGUGCAGCUGCUUUAU | B GUUUGUGCAGCUGCUUUAUTT B | 2372 |
| R-008395776-000L | 2062 | 297 | GUUUGUGCAGCUGCUUUAU | AUAAAGCAGCUGCACAAACUU | 2373 |
| R-008395779-000M | 2278 | 298 | CAAGAAACGGCUUUCAGUU | B CAAGAAACGGCUUUCAGUUTT B | 2374 |
| R-008395779-000M | 2278 | 298 | CAAGAAACGGCUUUCAGUU | AACUGAAAGCCGUUUCUUGUU | 2375 |
| R-008395782-000U | 1877 | 299 | GUUCAGUUGCUUGUUCGUG | CACGAACAAGCAACUGAACUU | 2377 |
| R-008395782-000U | 1877 | 299 | GUUCAGUUGCUUGUUCGUG | B GUUCAGUUGCUUGUUCGUGTT B | 2376 |
| R-008395785-000V | 1499 | 300 | UCAGAUGAUAUAAAUGGG | B UCAGAUGAUAUAAAUGUGGTT B | 2378 |
| R-008395785-000V | 1499 | 300 | UCAGAUGAUAUAAAUGGG | CCACAUUUAUAUCAUCUGAUU | 2379 |
| R-008395788-000W | 1136 | 301 | AAUGUUAAAUUCUUGGCUA | B AAUGUUAAAUUCUUGGCUATT B | 2380 |
| R-008395788-000W | 1136 | 301 | AAUGUUAAAUUCUUGGCUA | UAGCCAAGAAUUUAACAUUUU | 2381 |
| R-008395791-000C | 1494 | 302 | UGGGUUCAGAUGAUAUAAA | UUUAUAUCAUCUGAACCCAUU | 2383 |
| R-008395791-000C | 1494 | 302 | UGGGUUCAGAUGAUAUAAA | B UGGGUUCAGAUGAUAUAAATT B | 2382 |
| R-008395794-000D | 1972 | 303 | AAUAGUUGAAGGUUGUACC | B AAUAGUUGAAGGUUGUACCTT B | 2384 |
| R-008395794-000D | 1972 | 303 | AAUAGUUGAAGGUUGUACC | GGUACAACCUUCAACUAUUUU | 2385 |
| R-008395797-000E | 668 | 304 | CAUGCAGUUGUAAACUUGA | UCAAGUUUACAACUGCAUGUU | 2387 |
| R-008395797-000E | 668 | 304 | CAUGCAGUUGUAAACUUGA | B CAUGCAGUUGUAAACUUGATT B | 2386 |
| R-008395800-000X | 2945 | 305 | AAUCUGAAUAAAGUGUAAC | GUUACACUUUAUUCAGAUUUU | 2389 |
| R-008395800-000X | 2945 | 305 | AAUCUGAAUAAAGUGUAAC | B AAUCUGAAUAAAGUGUAACTT B | 2388 |
| R-008395803-000Y | 2492 | 306 | CACCACCCUGGUGCUGACU | B CACCACCCUGGUGCUGACUTT B | 2390 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008395803-000Y | 2492 | 306 | CACCACCCUGGUGCUGACU | AGUCAGCACCAGGGUGGUGUU | 2391 |
| R-008395806-000Z | 293 | 307 | GAGUUGGACAUGGCCAUGG | B GAGUUGGACAUGGCCAUGGTT B | 2392 |
| R-008395806-000Z | 293 | 307 | GAGUUGGACAUGGCCAUGG | CCAUGGCCAUGUCCAACUCUU | 2393 |
| R-008395809-000A | 1905 | 308 | AUACCCAGCGCCGUACGUC | B AUACCCAGCGCCGUACGUCTT B | 2394 |
| R-008395809-000A | 1905 | 308 | AUACCCAGCGCCGUACGUC | GACGUACGGCGCUGGGUAUU | 2395 |
| R-008395812-000G | 944 | 309 | GAGGGCUUACUGGCCAUCU | AGAUGGCCAGUAAGCCCUCUU | 2397 |
| R-008395812-000G | 944 | 309 | GAGGGCUUACUGGCCAUCU | B GAGGGCUUACUGGCCAUCUTT B | 2396 |
| R-008395815-000H | 581 | 310 | GAGGGCAUGCAGAUCCCAU | B GAGGGCAUGCAGAUCCCAUTT B | 2398 |
| R-008395815-000H | 581 | 310 | GAGGGCAUGCAGAUCCCAU | AUGGGAUCUGCAUGCCCUCUU | 2399 |
| R-008395818-000J | 1454 | 311 | GAAGGGAUGGAAGGUCCC | B GAAGGGAUGGAAGGUCUCCTT B | 2400 |
| R-008395818-000J | 1454 | 311 | GAAGGGAUGGAAGGUCCC | GGAGACCUUCCAUCCCUUCUU | 2401 |
| R-008395821-000R | 2254 | 312 | GUCUGAGGACAAGCCACAA | B GUCUGAGGACAAGCCACAATT B | 2402 |
| R-008395821-000R | 2254 | 312 | GUCUGAGGACAAGCCACAA | UUGUGGCUUGUCCUCAGACUU | 2403 |
| R-008395824-000S | 1837 | 313 | UCAUGCACCUUUGCGUGAG | CUCACGCAAAGGUGCAUGAUU | 2405 |
| R-008395824-000S | 1837 | 313 | UCAUGCACCUUUGCGUGAG | B UCAUGCACCUUUGCGUGAGTT B | 2404 |
| R-008395827-000T | 1425 | 314 | GGAAUCUUUCAGAUGCUGC | B GGAAUCUUUCAGAUGCUGCTT B | 2406 |
| R-008395827-000T | 1425 | 314 | GGAAUCUUUCAGAUGCUGC | GCAGCAUCUGAAAGAUUCCUU | 2407 |
| R-008395830-000Z | 1372 | 315 | UCACCUGACAGAUCCAAGU | ACUUGGAUCUGUCAGGUGAUU | 2409 |
| R-008395830-000Z | 1372 | 315 | UCACCUGACAGAUCCAAGU | B UCACCUGACAGAUCCAAGUTT B | 2408 |
| R-008395833-000A | 1298 | 316 | CUGAAGGUGCUAUCUGUCU | B CUGAAGGUGCUAUCUGUCUTT B | 2410 |
| R-008395833-000A | 1298 | 316 | CUGAAGGUGCUAUCUGUCU | AGACAGAUAGCACCUUCAGUU | 2411 |
| R-008395836-000B | 1674 | 317 | GUCAUCUGACCAGCCGACA | B GUCAUCUGACCAGCCGACATT B | 2412 |
| R-008395836-000B | 1674 | 317 | GUCAUCUGACCAGCCGACA | UGUCGGCUGGUCAGAUGACUU | 2413 |
| R-008395839-000C | 1864 | 318 | CAUUCCACGACUAGUUCAG | CUGAACUAGUCGUGGAAUGUU | 2415 |
| R-008395839-000C | 1864 | 318 | CAUUCCACGACUAGUUCAG | B CAUUCCACGACUAGUUCAGTT B | 2414 |
| R-008395842-000J | 2404 | 319 | UGAUCCUAGCUAUCGUUCU | AGAACAGAUAGCUAGGAUCAUU | 2417 |
| R-008395842-000J | 2404 | 319 | UGAUCCUAGCUAUCGUUCU | B UGAUCCUAGCUAUCGUUCUTT B | 2416 |
| R-008395845-000K | 1992 | 320 | GAGCCCUUCACAUCCUAGC | GCUAGGAUGUGAAGGGCUCUU | 2419 |
| R-008395845-000K | 1992 | 320 | GAGCCCUUCACAUCCUAGC | B GAGCCCUUCACAUCCUAGCTT B | 2418 |
| R-008395848-000L | 2124 | 73 | GUGAACUUGCUCAGGACAA | UUGUCCUGAGCAAGUUCACUU | 2421 |
| R-008395848-000L | 2124 | 73 | GUGAACUUGCUCAGGACAA | B GUGAACUUGCUCAGGACAATT B | 2420 |
| R-008395851-000T | 578 | 321 | GAUGAGGGCAUGCAGAUCC | GGAUCUGCAUGCCCUCAUCUU | 2423 |
| R-008395851-000T | 578 | 321 | GAUGAGGGCAUGCAGAUCC | B GAUGAGGGCAUGCAGAUCCTT B | 2422 |
| R-008395854-000U | 3091 | 322 | AUGGGUAGGGUAAAUCAGU | B AUGGGUAGGGUAAAUCAGUTT B | 2424 |
| R-008395854-000U | 3091 | 322 | AUGGGUAGGGUAAAUCAGU | ACUGAUUUACCCUACCCAUUU | 2425 |
| R-008395857-000V | 720 | 323 | GUGCAAUCCCUGAACUGAC | B GUGCAAUCCCUGAACUGACTT B | 2426 |
| R-008395857-000V | 720 | 323 | GUGCAAUCCCUGAACUGAC | GUCAGUUCAGGGAUUGCACUU | 2427 |
| R-008395860-000B | 2054 | 324 | AUUCCAUUGUUUGUGCAGC | B AUUCCAUUGUUUGUGCAGCTT B | 2428 |
| R-008395860-000B | 2054 | 324 | AUUCCAUUGUUUGUGCAGC | GCUGCACAAACAAUGGAAUUU | 2429 |
| R-008395863-000C | 1237 | 42 | UUUAGUAAAUAUAAUGAGG | CCUCAUUAUAUUUACUAAAUU | 2431 |
| R-008395863-000C | 1237 | 42 | UUUAGUAAAUAUAAUGAGG | B UUUAGUAAAUAUAAUGAGGTT B | 2430 |
| R-008395866-000D | 374 | 325 | CAUUCUGGUGCCACUACCA | UGGUAGUGGCACCAGAAUGUU | 2433 |
| R-008395866-000D | 374 | 325 | CAUUCUGGUGCCACUACCA | B CAUUCUGGUGCCACUACCATT B | 2432 |
| R-008395869-000E | 868 | 326 | UACCAUGCAGAAUACAAAU | AUUUGUAUUCUGCAUGGUAUU | 2435 |
| R-008395869-000E | 868 | 326 | UACCAUGCAGAAUACAAAU | B UACCAUGCAGAAUACAAAUTT B | 2434 |
| R-008395872-000L | 626 | 23 | ACUAAUGUCCAGCGUUUGG | CCAAACGCUGGACAUUAGUUU | 2437 |
| R-008395872-000L | 626 | 23 | ACUAAUGUCCAGCGUUUGG | B ACUAAUGUCCAGCGUUUGGTT B | 2436 |
| R-008395875-000M | 1716 | 327 | AUGCAGUUCGCCUUCACUA | B AUGCAGUUCGCCUUCACUATT B | 2438 |
| R-008395875-000M | 1716 | 327 | AUGCAGUUCGCCUUCACUA | UAGUGAAGGCGAACUGCAUUU | 2439 |
| R-008395878-000N | 950 | 328 | UUACUGGCCAUCUUUAAGU | B UUACUGGCCAUCUUUAAGUTT B | 2440 |
| R-008395878-000N | 950 | 328 | UUACUGGCCAUCUUUAAGU | ACUUAAAGAUGGCCAGUAAUU | 2441 |
| R-008395881-000V | 1489 | 329 | GCUUCGGGUUCAGAUGAU | B GCUUCGGGUUCAGAUGAUUT B | 2442 |
| R-008395881-000V | 1489 | 329 | GCUUCGGGUUCAGAUGAU | AUCAUCUGAACCCAGAAGCUU | 2443 |
| R-008395884-000W | 1451 | 330 | CAGGAAGGGAUGGAAGGUC | B CAGGAAGGGAUGGAAGGUCTT B | 2444 |
| R-008395884-000W | 1451 | 330 | CAGGAAGGGAUGGAAGGUC | GACCUUCCAUCCCUUCCUGUU | 2445 |
| R-008395887-000X | 438 | 159 | UGGAUACCUCCCAAGUCCU | AGGACUUGGGAGGUAUCCAUU | 2447 |
| R-008395887-000X | 438 | 159 | UGGAUACCUCCCAAGUCCU | B UGGAUACCUCCCAAGUCCUTT B | 2446 |
| R-008395890-000D | 1181 | 331 | GCUUAUGGCAACCAAGAAA | UUUCUUGGUUGCCAUAAGCUU | 2449 |
| R-008395890-000D | 1181 | 331 | GCUUAUGGCAACCAAGAAA | B GCUUAUGGCAACCAAGAAATT B | 2448 |
| R-008395893-000E | 1633 | 332 | UGACAGGGAAGACAUCACU | AGUGAUGUCUUCCUGUCAUU | 2451 |
| R-008395893-000E | 1633 | 332 | UGACAGGGAAGACAUCACU | B UGACAGGGAAGACAUCACUTT B | 2450 |
| R-008395896-000F | 2394 | 333 | AUCGCCAGGAUGAUCCUAG | CUAGGAUCAUCCUGGCGAUUU | 2453 |
| R-008395896-000F | 2394 | 333 | AUCGCCAGGAUGAUCCUAG | B AUCGCCAGGAUGAUCCUAGTT B | 2452 |
| R-008395899-000G | 1322 | 334 | AGUAAUAAGCCGGCUAUUG | B AGUAAUAAGCCGGCUAUUGTT B | 2454 |
| R-008395899-000G | 1322 | 334 | AGUAAUAAGCCGGCUAUUG | CAAUAGCCGGCUUAUUACUUU | 2455 |
| R-008395902-000Z | 884 | 335 | AAUGAUGUAGAAACAGCUC | GAGCUGUUUCUACAUCAUUUU | 2457 |
| R-008395902-000Z | 884 | 335 | AAUGAUGUAGAAACAGCUC | B AAUGAUGUAGAAACAGCUCTT B | 2456 |
| R-008395905-000A | 2255 | 336 | UCUGAGGACAAGCCACAAG | B UCUGAGGACAAGCCACAAGTT B | 2458 |
| R-008395905-000A | 2255 | 336 | UCUGAGGACAAGCCACAAG | CUUGUGGCUUGUCCUCAGAUU | 2459 |
| R-008395908-000B | 1466 | 337 | GGUCUCCUUGGGACUCUUG | CAAGAGUCCCAAGGAGACCUU | 2461 |
| R-008395908-000B | 1466 | 337 | GGUCUCCUUGGGACUCUUG | B GGUCUCCUUGGGACUCUUGTT B | 2460 |
| R-008395911-000H | 1399 | 338 | UGUUCAGAACUGUCUUUGG | CCAAAGACAGUUCUGAACAUU | 2463 |
| R-008395911-000H | 1399 | 338 | UGUUCAGAACUGUCUUUGG | B UGUUCAGAACUGUCUUUGGTT B | 2462 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008395914-000J | 378 | 339 | CUGGUGCCACUACCACAGC | B CUGGUGCCACUACCACAGCTT B | 2464 |
| R-008395914-000J | 378 | 339 | CUGGUGCCACUACCACAGC | GCUGUGGUAGUGGCACCAGUU | 2465 |
| R-008395917-000K | 1921 | 340 | GUCCAUGGGUGGGACACAG | CUGUGUCCCACCCAUGGACUU | 2467 |
| R-008395917-000K | 1921 | 340 | GUCCAUGGGUGGGACACAG | B GUCCAUGGGUGGGACACAGTT B | 2466 |
| R-008395920-000S | 1085 | 341 | GUGCGUUUAGCUGGUGGGC | B GUGCGUUUAGCUGGUGGGCTT B | 2468 |
| R-008395920-000S | 1085 | 341 | GUGCGUUUAGCUGGUGGGC | GCCCACCAGCUAAACGCACUU | 2469 |
| R-008395923-000T | 865 | 342 | ACGUACCAUGCAGAAUACA | B ACGUACCAUGCAGAAUACATT B | 2470 |
| R-008395923-000T | 865 | 342 | ACGUACCAUGCAGAAUACA | UGUAUUCUGCAUGGUACGUUU | 2471 |
| R-008395926-000U | 2015 | 343 | GAUGUUCACAACCGAAUUG | B GAUGUUCACAACCGAAUUGTT B | 2472 |
| R-008395926-000U | 2015 | 343 | GAUGUUCACAACCGAAUUG | CAAUUCGGUUGUGAACAUCUU | 2473 |
| R-008395929-000V | 1195 | 344 | AGAAAGCAAGCUCAUCAUA | B AGAAAGCAAGCUCAUCAUATT B | 2474 |
| R-008395929-000V | 1195 | 344 | AGAAAGCAAGCUCAUCAUA | UAUGAUGAGCUUGCUUUCUUU | 2475 |
| R-008395932-000B | 1484 | 345 | GUUCAGCUUCUGGGUUCAG | CUGAACCCAGAAGCUGAACUU | 2477 |
| R-008395932-000B | 1484 | 345 | GUUCAGCUUCUGGGUUCAG | B GUUCAGCUUCUGGGUUCAGTT B | 2476 |
| R-008395935-000C | 1855 | 346 | GCAGGGUGCCAUUCCACGA | B GCAGGGUGCCAUUCCACGATT B | 2478 |
| R-008395935-000C | 1855 | 346 | GCAGGGUGCCAUUCCACGA | UCGUGGAAUGGCACCCUGCUU | 2479 |
| R-008395938-000D | 1341 | 347 | UAGAAGCUGGUGGAAUGCA | B UAGAAGCUGGUGGAAUGCATT B | 2480 |
| R-008395938-000D | 1341 | 347 | UAGAAGCUGGUGGAAUGCA | UGCAUUCCACCAGCUUCUAUU | 2481 |
| R-008395950-000U | 1963 | 348 | CAUGGAAGAAAUAGUUGAA | UUCAACUAUUUCUUCCAUGUU | 2483 |
| R-008395950-000U | 1963 | 348 | CAUGGAAGAAAUAGUUGAA | B CAUGGAAGAAAUAGUUGAATT B | 2482 |
| R-008395953-000V | 2362 | 349 | UGAUAUUGGUGCCCAGGGA | B UGAUAUUGGUGCCCAGGGATT B | 2484 |
| R-008395953-000V | 2362 | 349 | UGAUAUUGGUGCCCAGGGA | UCCCUGGGCACCAAUAUCAUU | 2485 |
| R-008395956-000W | 584 | 350 | GGCAUGCAGAUCCCAUCUA | B GGCAUGCAGAUCCCAUCUATT B | 2486 |
| R-008395956-000W | 584 | 350 | GGCAUGCAGAUCCCAUCUA | UAGAUGGGAUCUGCAUGCCUU | 2487 |
| R-008395959-000X | 1613 | 351 | CGUACUGUCCUUCGGGCUG | B CGUACUGUCCUUCGGGCUGTT B | 2488 |
| R-008395959-000X | 1613 | 351 | CGUACUGUCCUUCGGGCUG | CAGCCCGAAGGACAGUACGUU | 2489 |
| R-008395962-000D | 1155 | 352 | UUACGACAGACUGCCUUCA | UGAAGGCAGUCUGUCGUAAUU | 2491 |
| R-008395962-000D | 1155 | 352 | UUACGACAGACUGCCUUCA | B UUACGACAGACUGCCUUCATT B | 2490 |
| R-008395965-000E | 334 | 353 | UAGUCACUGGCAGCAACAG | B UAGUCACUGGCAGCAACAGTT B | 2492 |
| R-008395965-000E | 334 | 353 | UAGUCACUGGCAGCAACAG | CUGUUGCUGCCAGUGACUAUU | 2493 |
| R-008395968-000F | 1031 | 354 | GCCAUUACAACUCUCCACA | B GCCAUUACAACUCUCCACATT B | 2494 |
| R-008395968-000F | 1031 | 354 | GCCAUUACAACUCUCCACA | UGUGGAGAGUUGUAAUGGCUU | 2495 |
| R-008395971-000M | 1725 | 355 | GCCUUCACUAUGGACUACC | B GCCUUCACUAUGGACUACCTT B | 2496 |
| R-008395971-000M | 1725 | 355 | GCCUUCACUAUGGACUACC | GGUAGUCCAUAGUGAAGGCUU | 2497 |
| R-008395974-000N | 2018 | 356 | GUUCACAACCGAAUUGUUA | B GUUCACAACCGAAUUGUUATT B | 2498 |
| R-008395974-000N | 2018 | 356 | GUUCACAACCGAAUUGUUA | UAACAAUUCGGUUGUGAACUU | 2499 |
| R-008395977-000P | 914 | 357 | GGGACCUUGCAUAACCUUU | AAAGGUUAUGCAAGGUCCCUU | 2501 |
| R-008395977-000P | 914 | 357 | GGGACCUUGCAUAACCUUU | B GGGACCUUGCAUAACCUUUTT B | 2500 |
| R-008395980-000W | 2264 | 358 | AAGCCACAAGAUUACAAGA | B AAGCCACAAGAUUACAAGATT B | 2502 |
| R-008395980-000W | 2264 | 358 | AAGCCACAAGAUUACAAGA | UCUUGUAAUCUUGUGGCUUUU | 2503 |
| R-008395983-000X | 343 | 359 | GCAGCAACAGUCUUACCUG | CAGGUAAGACUGUUGCUGCUU | 2505 |
| R-008395983-000X | 343 | 359 | GCAGCAACAGUCUUACCUG | B GCAGCAACAGUCUUACCUGTT B | 2504 |
| R-008395986-000Y | 1056 | 360 | UAUUACAUCAAGAAGGAGC | B UAUUACAUCAAGAAGGAGCTT B | 2506 |
| R-008395986-000Y | 1056 | 360 | UAUUACAUCAAGAAGGAGC | GCUCCUUCUUGAUGUAAUAUU | 2507 |
| R-008395992-000F | 772 | 361 | UAAUAAGGCUGCAGUUAUG | B UAAUAAGGCUGCAGUUAUGTT B | 2508 |
| R-008395992-000F | 772 | 361 | UAAUAAGGCUGCAGUUAUG | CAUAACUGCAGCCUUAUUAUU | 2509 |
| R-008395995-000G | 1390 | 91 | UCAACGUCUUGUUCAGAAC | GUUCUGAACAAGACGUUGAUU | 2511 |
| R-008395995-000G | 1390 | 91 | UCAACGUCUUGUUCAGAAC | B UCAACGUCUUGUUCAGAACTT B | 2510 |
| R-008395998-000H | 1959 | 183 | UCCGCAUGGAAGAAAUAGU | ACUAUUUCUUCCAUGCGGAUU | 2513 |
| R-008395998-000H | 1959 | 183 | UCCGCAUGGAAGAAAUAGU | B UCCGCAUGGAAGAAAUAGUTT B | 2512 |
| R-008396004-000Y | 763 | 362 | GGUGGUGGUUAAUAAGGCU | B GGUGGUGGUUAAUAAGGCUTT B | 2514 |
| R-008396004-000Y | 763 | 362 | GGUGGUGGUUAAUAAGGCU | AGCCUUAUUAACCACCACCUU | 2515 |
| R-008396010-000F | 628 | 363 | UAAUGUCCAGCGUUUGGCU | B UAAUGUCCAGCGUUUGGCUTT B | 2516 |
| R-008396010-000F | 628 | 363 | UAAUGUCCAGCGUUUGGCU | AGCCAAACGCUGGACAUUAUU | 2517 |
| R-008396013-000G | 399 | 364 | CUUCUCUGAGUGGUAAAGG | B CUUCUCUGAGUGGUAAAGGTT B | 2518 |
| R-008396013-000G | 399 | 364 | CUUCUCUGAGUGGUAAAGG | CCUUUACCACUCAGAGAAGUU | 2519 |
| R-008396016-000H | 1682 | 365 | ACCAGCCGACACCAAGAAG | CUUCUUGGUGUCGGCUGGUUU | 2521 |
| R-008396016-000H | 1682 | 365 | ACCAGCCGACACCAAGAAG | B ACCAGCCGACACCAAGAAGTT B | 2520 |
| R-008396019-000J | 441 | 366 | AUACCUCCCAAGUCCUGUA | B AUACCUCCCAAGUCCUGUATT B | 2522 |
| R-008396019-000J | 441 | 366 | AUACCUCCCAAGUCCUGUA | UACAGGACUUGGGAGGUAUUU | 2523 |
| R-008396022-000R | 1729 | 367 | UCACUAUGGACUACCAGUU | B UCACUAUGGACUACCAGUUTT B | 2524 |
| R-008396022-000R | 1729 | 367 | UCACUAUGGACUACCAGUU | AACUGGUAGUCCAUAGUGAUU | 2525 |
| R-008396025-000S | 1902 | 368 | AGGAUACCCAGCGCCGUAC | GUACGGCGCUGGGUAUCCUUU | 2527 |
| R-008396025-000S | 1902 | 368 | AGGAUACCCAGCGCCGUAC | B AGGAUACCCAGCGCCGUACTT B | 2526 |
| R-008396028-000T | 1637 | 369 | AGGGAAGACAUCACUGAGC | B AGGGAAGACAUCACUGAGCTT B | 2528 |
| R-008396028-000T | 1637 | 369 | AGGGAAGACAUCACUGAGC | GCUCAGUGAUGUCUUCCCUUU | 2529 |
| R-008396031-000Z | 2391 | 370 | GAUAUCGCCAGGAUGAUCC | B GAUAUCGCCAGGAUGAUCCTT B | 2530 |
| R-008396031-000Z | 2391 | 370 | GAUAUCGCCAGGAUGAUCC | GGAUCAUCCUGGCGAUAUCUU | 2531 |
| R-008396034-000A | 501 | 371 | AAGUAGCUGAUAUUGAUGG | B AAGUAGCUGAUAUUGAUGGTT B | 2532 |
| R-008396034-000A | 501 | 371 | AAGUAGCUGAUAUUGAUGG | CCAUCAAUAUCAGCUACUUUU | 2533 |
| R-008396037-000B | 1358 | 372 | CAAGCUUUAGGACUUCACC | B CAAGCUUUAGGACUUCACCTT B | 2534 |
| R-008396037-000B | 1358 | 372 | CAAGCUUUAGGACUUCACC | GGUGAAGUCCUAAAGCUUGUU | 2535 |
| R-008396040-000H | 1821 | 373 | CCCUUUGUCCCGCAAAUCA | B CCCUUUGUCCCGCAAAUCATT B | 2536 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396040-000H | 1821 | 373 | CCCUUUGUCCCGCAAAUCA | UGAUUUGCGGGACAAAGGGUU | 2537 |
| R-008396043-000J | 575 | 374 | UUAGAUGAGGGCAUGCAGA | B UUAGAUGAGGGCAUGCAGAUT B | 2538 |
| R-008396043-000J | 575 | 374 | UUAGAUGAGGGCAUGCAGA | UCUGCAUGCCCUCAUCUAAUU | 2539 |
| R-008396046-000K | 528 | 375 | CAAUGACUCGAGCUCAGAG | B CAAUGACUCGAGCUCAGAGTT B | 2540 |
| R-008396046-000K | 528 | 375 | CAAUGACUCGAGCUCAGAG | CUCUGAGCUCGAGUCAUUGUU | 2541 |
| R-008396049-000L | 2433 | 376 | GUGGAUAUGGCCAGGAUGC | B GUGGAUAUGGCCAGGAUGCTT B | 2542 |
| R-008396049-000L | 2433 | 376 | GUGGAUAUGGCCAGGAUGC | GCAUCCUGGCCAUAUCCACUU | 2543 |
| R-008396052-000T | 1497 | 377 | GUUCAGAUGAUAUAAAUGU | ACAUUUAUAUCAUCUGAACUU | 2545 |
| R-008396052-000T | 1497 | 377 | GUUCAGAUGAUAUAAAUGU | B GUUCAGAUGAUAUAAAUGUTT B | 2544 |
| R-008396055-000U | 2134 | 378 | UCAGGACAAGGAAGCUGCA | B UCAGGACAAGGAAGCUGCATT B | 2546 |
| R-008396055-000U | 2134 | 378 | UCAGGACAAGGAAGCUGCA | UGCAGCUUCCUUGUCCUGAUU | 2547 |
| R-008396058-000V | 2160 | 379 | UUGAAGCUGAGGGAGCCAC | GUGGCUCCCUCAGCUUCAUU | 2549 |
| R-008396058-000V | 2160 | 379 | UUGAAGCUGAGGGAGCCAC | B UUGAAGCUGAGGGAGCCACTT B | 2548 |
| R-008396061-000B | 291 | 380 | UGGAGUUGGACAUGGCCAU | AUGGCCAUGUCCAACUCCAUU | 2551 |
| R-008396061-000B | 291 | 380 | UGGAGUUGGACAUGGCCAU | B UGGAGUUGGACAUGGCCAUTT B | 2550 |
| R-008396064-000C | 657 | 381 | AGAUGCUGAAACAUGCAGU | B AGAUGCUGAAACAUGCAGUTT B | 2552 |
| R-008396064-000C | 657 | 381 | AGAUGCUGAAACAUGCAGU | ACUGCAUGUUUCAGCAUCUUU | 2553 |
| R-008396067-000D | 1575 | 382 | UGAUGGUCUGCCAAGUGGG | B UGAUGGUCUGCCAAGUGGGTT B | 2554 |
| R-008396067-000D | 1575 | 382 | UGAUGGUCUGCCAAGUGGG | CCCACUUGGCAGACCAUCAUU | 2555 |
| R-008396070-000K | 667 | 383 | ACAUGCAGUUGUAAACUUG | CAAGUUUACAACUGCAUGUUU | 2557 |
| R-008396070-000K | 667 | 383 | ACAUGCAGUUGUAAACUUG | B ACAUGCAGUUGUAAACUUGTT B | 2556 |
| R-008396076-000M | 2190 | 384 | CAGAGUUACUUCACUCUAG | B CAGAGUUACUUCACUCUAGTT B | 2558 |
| R-008396076-000M | 2190 | 384 | CAGAGUUACUUCACUCUAG | CUAGAGUGAAGUAACUCUGUU | 2559 |
| R-008396079-000N | 532 | 385 | GACUCGAGCUCAGAGGGUA | UACCCUCUGAGCUCGAGUCUU | 2561 |
| R-008396079-000N | 532 | 385 | GACUCGAGCUCAGAGGGUA | B GACUCGAGCUCAGAGGGUATT B | 2560 |
| R-008396082-000V | 953 | 386 | CUGGCCAUCUUUAAGUCUG | CAGACUUAAAGAUGGCCAGUU | 2563 |
| R-008396082-000V | 953 | 386 | CUGGCCAUCUUUAAGUCUG | B CUGGCCAUCUUUAAGUCUGTT B | 2562 |
| R-008396085-000W | 3188 | 387 | UACGAUGCUUCAAGAGAAA | UUUCUCUUGAAGCAUCGUAUU | 2565 |
| R-008396085-000W | 3188 | 387 | UACGAUGCUUCAAGAGAAA | B UACGAUGCUUCAAGAGAAATT B | 2564 |
| R-008396088-000X | 2301 | 388 | UGACCAGCUCUCUCUUCAG | B UGACCAGCUCUCUCUUCAGTT B | 2566 |
| R-008396088-000X | 2301 | 388 | UGACCAGCUCUCUCUUCAG | CUGAAGAGAGAGCUGGUCAUU | 2567 |
| R-008396091-000D | 2310 | 389 | CUCUCUUCAGAACAGAGCC | B CUCUCUUCAGAACAGAGCCTT B | 2568 |
| R-008396091-000D | 2310 | 389 | CUCUCUUCAGAACAGAGCC | GGCUCUGUUCUGAAGAGAGUU | 2569 |
| R-008396094-000E | 2287 | 390 | GCUUUCAGUUGAGCUGACC | B GCUUUCAGUUGAGCUGACCTT B | 2570 |
| R-008396094-000E | 2287 | 390 | GCUUUCAGUUGAGCUGACC | GGUCAGCUCAACUGAAAGCUU | 2571 |
| R-008396097-000F | 1927 | 391 | GGGUGGGACACAGCAGCAA | UUGCUGCUGUGUCCCACCCUU | 2573 |
| R-008396097-000F | 1927 | 391 | GGGUGGGACACAGCAGCAA | B GGGUGGGACACAGCAGCAATT B | 2572 |
| R-008396100-000Y | 712 | 392 | UGCCACACGUGCAAUCCCU | AGGGAUUGCACGUGUGGCAUU | 2575 |
| R-008396100-000Y | 712 | 392 | UGCCACACGUGCAAUCCCU | B UGCCACACGUGCAAUCCCUTT B | 2574 |
| R-008396103-000Z | 2121 | 393 | UCUGUGAACUUGCUCAGGA | B UCUGUGAACUUGCUCAGGATT B | 2576 |
| R-008396103-000Z | 2121 | 393 | UCUGUGAACUUGCUCAGGA | UCCUGAGCAAGUUCACAGAUU | 2577 |
| R-008396106-000A | 2898 | 394 | UGAGUAAUGGUGUAGAACA | B UGAGUAAUGGUGUAGAACATT B | 2578 |
| R-008396106-000A | 2898 | 394 | UGAGUAAUGGUGUAGAACA | UGUUCUACACCAUUACUCAUU | 2579 |
| R-008396109-000B | 1799 | 395 | GUUGGAUUGAUUCGAAAUC | B GUUGGAUUGAUUCGAAAUCTT B | 2580 |
| R-008396109-000B | 1799 | 395 | GUUGGAUUGAUUCGAAAUC | GAUUUCGAAUCAAUCCAACUU | 2581 |
| R-008396112-000H | 1036 | 396 | UACAACUCUCCACAACCUU | AAGGUUGUGGAGAGUUGUAUU | 2583 |
| R-008396112-000H | 1036 | 396 | UACAACUCUCCACAACCUU | B UACAACUCUCCACAACCUUTT B | 2582 |
| R-008396115-000J | 449 | 397 | CAAGUCCUGUAUGAGUGGG | CCCACUCAUACAGGACUUGUU | 2585 |
| R-008396115-000J | 449 | 397 | CAAGUCCUGUAUGAGUGGG | B CAAGUCCUGUAUGAGUGGGTT B | 2584 |
| R-008396118-000K | 1452 | 398 | AGGAAGGGAUGGAAGGUCU | B AGGAAGGGAUGGAAGGUCUTT B | 2586 |
| R-008396118-000K | 1452 | 398 | AGGAAGGGAUGGAAGGUCU | AGACCUUCCAUCCCUUCCUUU | 2587 |
| R-008396124-000T | 1203 | 399 | AGCUCAUCAUACUGGCUAG | B AGCUCAUCAUACUGGCUAGTT B | 2588 |
| R-008396124-000T | 1203 | 399 | AGCUCAUCAUACUGGCUAG | CUAGCCAGUAUGAUGAGCUUU | 2589 |
| R-008396130-000A | 1357 | 400 | GCAAGCUUUAGGACUUCAC | GUGAAGUCCUAAAGCUUGCUU | 2591 |
| R-008396130-000A | 1357 | 400 | GCAAGCUUUAGGACUUCAC | B GCAAGCUUUAGGACUUCACTT B | 2590 |
| R-008396133-000B | 1512 | 401 | AUGUGGUCACCUGUGCAGC | GCUGCACAGGUGACCACAUU | 2593 |
| R-008396133-000B | 1512 | 401 | AUGUGGUCACCUGUGCAGC | B AUGUGGUCACCUGUGCAGCTT B | 2592 |
| R-008396136-000C | 275 | 402 | ACUCAAGCUGAUUUGAUGG | B ACUCAAGCUGAUUUGAUGGTT B | 2594 |
| R-008396136-000C | 275 | 402 | ACUCAAGCUGAUUUGAUGG | CCAUCAAAUCAGCUUGAGUUU | 2595 |
| R-008396139-000D | 299 | 403 | GACAUGGCCAUGGAACCAG | CUGGUUCCAUGGCCAUGUCUU | 2597 |
| R-008396139-000D | 299 | 403 | GACAUGGCCAUGGAACCAG | B GACAUGGCCAUGGAACCAGTT B | 2596 |
| R-008396142-000K | 1241 | 404 | GUAAAUAUAAUGAGGACCU | B GUAAAUAUAAUGAGGACCUTT B | 2598 |
| R-008396142-000K | 1241 | 404 | GUAAAUAUAAUGAGGACCU | AGGUCCUCAUUAUAUUUACUU | 2599 |
| R-008396145-000L | 1961 | 405 | CGCAUGGAAGAAAUAGUUG | CAACAUUUCUUCCAUGCGUU | 2601 |
| R-008396145-000L | 1961 | 405 | CGCAUGGAAGAAAUAGUUG | B CGCAUGGAAGAAAUAGUUGTT B | 2600 |
| R-008396148-000M | 1436 | 406 | GAUGCUGCAACUAAACAGG | B GAUGCUGCAACUAAACAGGTT B | 2602 |
| R-008396148-000M | 1436 | 406 | GAUGCUGCAACUAAACAGG | CCUGUUUAGUUGCAGCAUCUU | 2603 |
| R-008396151-000U | 2469 | 407 | UGAUGGAACAUGAGAUGGG | B UGAUGGAACAUGAGAUGGGTT B | 2604 |
| R-008396151-000U | 2469 | 407 | UGAUGGAACAUGAGAUGGG | CCCAUCUCAUGUUCCAUCAUU | 2605 |
| R-008396154-000V | 760 | 408 | CCAGGUGGUGGUUAAUAAG | B CCAGGUGGUGGUUAAUAAGTT B | 2606 |
| R-008396154-000V | 760 | 408 | CCAGGUGGUGGUUAAUAAG | CUUAUUAACCACCACCUGGUU | 2607 |
| R-008396157-000W | 2504 | 141 | GCUGACUAUCCAGUUGAUG | CAUCAACUGGAUAGUCAGCUU | 2609 |
| R-008396157-000W | 2504 | 141 | GCUGACUAUCCAGUUGAUG | B GCUGACUAUCCAGUUGAUGTT B | 2608 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396160-000C | 2257 | 409 | UGAGGACAAGCCACAAGAU | AUCUUGUGGCUUGUCCUCAUU | 2611 |
| R-008396160-000C | 2257 | 409 | UGAGGACAAGCCACAAGAU | B UGAGGACAAGCCACAAGAUTT B | 2610 |
| R-008396163-000D | 952 | 410 | ACUGGCCAUCUUUAAGUCU | AGACUUAAAGAUGGCCAGUUU | 2613 |
| R-008396163-000D | 952 | 410 | ACUGGCCAUCUUUAAGUCU | B ACUGGCCAUCUUUAAGUCUTT B | 2612 |
| R-008396166-000E | 2283 | 411 | AACGGCUUUCAGUUGAGCU | B AACGGCUUUCAGUUGAGCUTT B | 2614 |
| R-008396166-000E | 2283 | 411 | AACGGCUUUCAGUUGAGCU | AGCUCAACUGAAAGCCGUUU | 2615 |
| R-008396169-000F | 1649 | 62 | ACUGAGCCUGCCAUCUGUG | B ACUGAGCCUGCCAUCUGUGTT B | 2616 |
| R-008396169-000F | 1649 | 62 | ACUGAGCCUGCCAUCUGUG | CACAGAUGGCAGGCUCAGUUU | 2617 |
| R-008396172-000M | 2014 | 8 | GGAUGUUCACAACCGAAUU | AAUUCGGUUGUGAACAUCCUU | 2619 |
| R-008396172-000M | 2014 | 8 | GGAUGUUCACAACCGAAUU | B GGAUGUUCACAACCGAAUUTT B | 2618 |
| R-008396175-000N | 1794 | 412 | CUACUGUUGGAUUGAUUCG | CGAAUCAAUCCAACAGUAGUU | 2621 |
| R-008396175-000N | 1794 | 412 | CUACUGUUGGAUUGAUUCG | B CUACUGUUGGAUUGAUUCGTT B | 2620 |
| R-008396178-000P | 1745 | 413 | GUUGUGGUUAAGCUCUUAC | B GUUGUGGUUAAGCUCUUACTT B | 2622 |
| R-008396178-000P | 1745 | 413 | GUUGUGGUUAAGCUCUUAC | GUAAGAGCUUAACCACAACUU | 2623 |
| R-008396181-000W | 1211 | 414 | AUACUGGCUAGUGGUGGAC | GUCCACCACUAGCCAGUAUUU | 2625 |
| R-008396181-000W | 1211 | 414 | AUACUGGCUAGUGGUGGAC | B AUACUGGCUAGUGGUGGACTT B | 2624 |
| R-008396184-000X | 2549 | 415 | GACCUCAUGGAUGGGCUGC | B GACCUCAUGGAUGGGCUGCTT B | 2626 |
| R-008396184-000X | 2549 | 415 | GACCUCAUGGAUGGGCUGC | GCAGCCCAUCCAUGAGGUCUU | 2627 |
| R-008396187-000Y | 2007 | 416 | UAGCUCGGGAUGUUCACAA | UUGUGAACAUCCCGAGCUAUU | 2629 |
| R-008396187-000Y | 2007 | 416 | UAGCUCGGGAUGUUCACAA | B UAGCUCGGGAUGUUCACAATT B | 2628 |
| R-008396190-000E | 2474 | 417 | GAACAUGAGAUGGGUGGCC | B GAACAUGAGAUGGGUGGCCTT B | 2630 |
| R-008396190-000E | 2474 | 417 | GAACAUGAGAUGGGUGGCC | GGCCACCCAUCUCAUGUUCUU | 2631 |
| R-008396193-000F | 1712 | 418 | CAGAAUGCAGUUCGCCUUC | GAAGGCGAACUGCAUUCUGUU | 2633 |
| R-008396193-000F | 1712 | 418 | CAGAAUGCAGUUCGCCUUC | B CAGAAUGCAGUUCGCCUUCTT B | 2632 |
| R-008396196-000G | 1919 | 419 | ACGUCCAUGGGUGGGACAC | B ACGUCCAUGGGUGGGACACTT B | 2634 |
| R-008396196-000G | 1919 | 419 | ACGUCCAUGGGUGGGACAC | GUGUCCCACCCAUGGACGUUU | 2635 |
| R-008396199-000H | 1000 | 420 | UGGUUCACCAGUGGAUUCU | AGAAUCCACUGGUGAACCAUU | 2637 |
| R-008396199-000H | 1000 | 420 | UGGUUCACCAGUGGAUUCU | B UGGUUCACCAGUGGAUUCUTT B | 2636 |
| R-008396202-000A | 2392 | 421 | AUAUCGCCAGGAUGAUCCU | AGGAUCAUCCUGGCGAUAUUU | 2639 |
| R-008396202-000A | 2392 | 421 | AUAUCGCCAGGAUGAUCCU | B AUAUCGCCAGGAUGAUCCUTT B | 2638 |
| R-008396205-000B | 1449 | 422 | AACAGGAAGGGAUGGAAGG | B AACAGGAAGGGAUGGAAGGTT B | 2640 |
| R-008396205-000B | 1449 | 422 | AACAGGAAGGGAUGGAAGG | CCUUCCAUCCCUUCCUGUUUU | 2641 |
| R-008396208-000C | 2294 | 423 | GUUGAGCUGACCAGCUCUC | GAGAGCUGGUCAGCUCAACUU | 2643 |
| R-008396208-000C | 2294 | 423 | GUUGAGCUGACCAGCUCUC | B GUUGAGCUGACCAGCUCUCTT B | 2642 |
| R-008396211-000J | 1135 | 424 | AAAUGUUAAAUUCUUGGCU | B AAAUGUUAAAUUCUUGGCUTT B | 2644 |
| R-008396211-000J | 1135 | 424 | AAAUGUUAAAUUCUUGGCU | AGCCAAGAAUUUAACAUUUUU | 2645 |
| R-008396214-000K | 822 | 14 | GACACGCUAUCAUGCGUUC | B GACACGCUAUCAUGCGUUCTT B | 2646 |
| R-008396214-000K | 822 | 14 | GACACGCUAUCAUGCGUUC | GAACGCAUGAUAGCGUGUCUU | 2647 |
| R-008396217-000L | 1333 | 425 | GGCUAUUGUAGAAGCUGGU | ACCAGCUUCUACAAUAGCCUU | 2649 |
| R-008396217-000L | 1333 | 425 | GGCUAUUGUAGAAGCUGGU | B GGCUAUUGUAGAAGCUGGUTT B | 2648 |
| R-008396220-000T | 1743 | 426 | CAGUUGUGGUUAAGCUCUU | AAGAGCUUAACCACAACUGUU | 2651 |
| R-008396220-000T | 1743 | 426 | CAGUUGUGGUUAAGCUCUU | B CAGUUGUGGUUAAGCUCUUTT B | 2650 |
| R-008396223-000U | 600 | 427 | CUACACAGUUUGAUGCUGC | GCAGCACAUCAAACUGUGUAGUU | 2653 |
| R-008396223-000U | 600 | 427 | CUACACAGUUUGAUGCUGC | B CUACACAGUUUGAUGCUGCTT B | 2652 |
| R-008396226-000V | 970 | 428 | UGGAGGCAUUCCUGCCCUG | CAGGGCAGGAAUGCCUCCAUU | 2655 |
| R-008396226-000V | 970 | 428 | UGGAGGCAUUCCUGCCCUG | B UGGAGGCAUUCCUGCCCUGTT B | 2654 |
| R-008396229-000W | 3137 | 429 | GGACAGUUUACCAGUUGCC | B GGACAGUUUACCAGUUGCCTT B | 2656 |
| R-008396229-000W | 3137 | 429 | GGACAGUUUACCAGUUGCC | GGCAACUGGUAAACUGUCCUU | 2657 |
| R-008396232-000C | 372 | 430 | UCCAUUCUGGUGCCACUAC | GUAGUGGCACCAGAAUGGAUU | 2659 |
| R-008396232-000C | 372 | 430 | UCCAUUCUGGUGCCACUAC | B UCCAUUCUGGUGCCACUACTT B | 2658 |
| R-008396235-000D | 1761 | 431 | UACACCCACCAUCCCACUG | B UACACCCACCAUCCCACUGTT B | 2660 |
| R-008396235-000D | 1761 | 431 | UACACCCACCAUCCCACUG | CAGUGGGAUGGUGGGUGUAUU | 2661 |
| R-008396238-000E | 1650 | 432 | CUGAGCCUGCCAUCUGUGC | GCACAGAUGGCAGGCUCAGUU | 2663 |
| R-008396238-000E | 1650 | 432 | CUGAGCCUGCCAUCUGUGC | B CUGAGCCUGCCAUCUGUGCTT B | 2662 |
| R-008396241-000L | 972 | 433 | GAGGCAUUCCUGCCCUGGU | B GAGGCAUUCCUGCCCUGGUTT B | 2664 |
| R-008396241-000L | 972 | 433 | GAGGCAUUCCUGCCCUGGU | ACCAGGGCAGGAAUGCCUCUU | 2665 |
| R-008396244-000M | 1147 | 434 | CUUGGCUAUUACGACAGAC | GUCUGUCGUAAUAGCCAAGUU | 2667 |
| R-008396244-000M | 1147 | 434 | CUUGGCUAUUACGACAGAC | B CUUGGCUAUUACGACAGACTT B | 2666 |
| R-008396247-000N | 565 | 435 | CCCUGAGACAUUAGAUGAG | B CCCUGAGACAUUAGAUGAGTT B | 2668 |
| R-008396247-000N | 565 | 435 | CCCUGAGACAUUAGAUGAG | CUCAUCUAAUGUCUCAGGGUU | 2669 |
| R-008396250-000V | 525 | 436 | AUGCAAUGACUCGAGCUCA | B AUGCAAUGACUCGAGCUCATT B | 2670 |
| R-008396250-000V | 525 | 436 | AUGCAAUGACUCGAGCUCA | UGAGCUCGAGUCAUUGCAUUU | 2671 |
| R-008396253-000W | 1599 | 437 | UAGAGGCUCUUGUGCGUAC | B UAGAGGCUCUUGUGCGUACTT B | 2672 |
| R-008396253-000W | 1599 | 437 | UAGAGGCUCUUGUGCGUAC | GUACGCACAAGAGCCUCUAUU | 2673 |
| R-008396256-000X | 2199 | 438 | UUCACUCUAGGAAUGAAGG | B UUCACUCUAGGAAUGAAGGTT B | 2674 |
| R-008396256-000X | 2199 | 438 | UUCACUCUAGGAAUGAAGG | CCUUCAUUCCUAGAGUGAAUU | 2675 |
| R-008396259-000Y | 2261 | 439 | GACAAGCCACAAGAUUACA | B GACAAGCCACAAGAUUACATT B | 2676 |
| R-008396259-000Y | 2261 | 439 | GACAAGCCACAAGAUUACA | UGUAAUCUUGUGGCUUGUCUU | 2677 |
| R-008396262-000E | 705 | 440 | CAGAACUUGCCACACGUGC | B CAGAACUUGCCACACGUGCTT B | 2678 |
| R-008396262-000E | 705 | 440 | CAGAACUUGCCACACGUGC | GCACGUGUGGCAAGUUCUGUU | 2679 |
| R-008396265-000F | 916 | 441 | GACCUUGCAUAACCUUUCC | B GACCUUGCAUAACCUUUCCTT B | 2680 |
| R-008396265-000F | 916 | 441 | GACCUUGCAUAACCUUUCC | GGAAAGGUUAUGCAAGGUCUU | 2681 |
| R-008396268-000G | 385 | 442 | CACUACCACAGCUCCUUCU | AGAAGGAGCUGUGGUAGUGUU | 2683 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396268-000G | 385 | 442 | CACUACCACAGCUCCUUCU | B CACUACCACAGCUCCUUCUTT B | 2682 |
| R-008396271-000N | 3076 | 443 | CUAUUUGGGAUAUGUAUGG | B CUAUUUGGGAUAUGUAUGGTT B | 2684 |
| R-008396271-000N | 3076 | 443 | CUAUUUGGGAUAUGUAUGG | CCAUACAUAUCCCAAAUAGUU | 2685 |
| R-008396274-000P | 1396 | 444 | UCUUGUUCAGAACUGUCUU | B UCUUGUUCAGAACUGUCUUTT B | 2686 |
| R-008396274-000P | 1396 | 444 | UCUUGUUCAGAACUGUCUU | AAGACAGUUCUGAACAAGAUU | 2687 |
| R-008396277-000R | 2447 | 445 | GAUGCCUUGGGUAUGGACC | GGUCCAUACCCAAGGCAUCUU | 2689 |
| R-008396277-000R | 2447 | 445 | GAUGCCUUGGGUAUGGACC | B GAUGCCUUGGGUAUGGACCTT B | 2688 |
| R-008396280-000X | 1338 | 446 | UUGUAGAAGCUGGUGGAAU | B UUGUAGAAGCUGGUGGAAUTT B | 2690 |
| R-008396280-000X | 1338 | 446 | UUGUAGAAGCUGGUGGAAU | AUUCCACCAGCUUCUACAAUU | 2691 |
| R-008396283-000Y | 2215 | 447 | AGGUGUGGCGACAUAUGCA | UGCAUAUGUCGCCACACCUUU | 2693 |
| R-008396283-000Y | 2215 | 447 | AGGUGUGGCGACAUAUGCA | B AGGUGUGGCGACAUAUGCATT B | 2692 |
| R-008396286-000Z | 722 | 448 | GCAAUCCCUGAACUGACAA | B GCAAUCCCUGAACUGACAATT B | 2694 |
| R-008396286-000Z | 722 | 448 | GCAAUCCCUGAACUGACAA | UUGUCAGUUCAGGGAUUGCUU | 2695 |
| R-008396289-000A | 1316 | 449 | UGCUCUAGUAAUAAGCCGG | CCGGCUUAUUACUAGAGCAUU | 2697 |
| R-008396289-000A | 1316 | 449 | UGCUCUAGUAAUAAGCCGG | B UGCUCUAGUAAUAAGCCGGTT B | 2696 |
| R-008396292-000G | 1687 | 450 | CCGACACCAAGAAGCAGAG | B CCGACACCAAGAAGCAGAGTT B | 2698 |
| R-008396292-000G | 1687 | 450 | CCGACACCAAGAAGCAGAG | CUCUGCUUCUUGGUGUCGGUU | 2699 |
| R-008396295-000H | 697 | 451 | AGAUGAUGCAGAACUUGCC | B AGAUGAUGCAGAACUUGCCTT B | 2700 |
| R-008396295-000H | 697 | 451 | AGAUGAUGCAGAACUUGCC | GGCAAGUUCUGCAUCAUCUUU | 2701 |
| R-008396298-000J | 2517 | 452 | UUGAUGGGCUGCCAGAUCU | B UUGAUGGGCUGCCAGAUCUTT B | 2702 |
| R-008396298-000J | 2517 | 452 | UUGAUGGGCUGCCAGAUCU | AGAUCUGGCAGCCCAUCAAUU | 2703 |
| R-008396301-000B | 1685 | 453 | AGCCGACACCAAGAAGCAG | B AGCCGACACCAAGAAGCAGTT B | 2704 |
| R-008396301-000B | 1685 | 453 | AGCCGACACCAAGAAGCAG | CUGCUUCUUGGUGUCGGCUUU | 2705 |
| R-008396304-000C | 3090 | 454 | UAUGGGUAGGGUAAAUCAG | CUGAUUUACCCUACCCAUAUU | 2707 |
| R-008396304-000C | 3090 | 454 | UAUGGGUAGGGUAAAUCAG | B UAUGGGUAGGGUAAAUCAGTT B | 2706 |
| R-008396307-000D | 1205 | 455 | CUCAUCAUACUGGCUAGUG | B CUCAUCAUACUGGCUAGUGTT B | 2708 |
| R-008396307-000D | 1205 | 455 | CUCAUCAUACUGGCUAGUG | CACUAGCCAGUAUGAUGAGUU | 2709 |
| R-008396310-000K | 1153 | 456 | UAUUACGACAGACUGCCUU | B UAUUACGACAGACUGCCUUTT B | 2710 |
| R-008396310-000K | 1153 | 456 | UAUUACGACAGACUGCCUU | AAGGCAGUCUGUCGUAAUAUU | 2711 |
| R-008396313-000L | 723 | 457 | CAAUCCCUGAACUGACAAA | B CAAUCCCUGAACUGACAAATT B | 2712 |
| R-008396313-000L | 723 | 457 | CAAUCCCUGAACUGACAAA | UUUGUCAGUUCAGGGAUUGUU | 2713 |
| R-008396316-000M | 1468 | 458 | UCUCCUUGGGACUCUUGUU | AACAAGAGUCCCAAGGAGAUU | 2715 |
| R-008396316-000M | 1468 | 458 | UCUCCUUGGGACUCUUGUU | B UCUCCUUGGGACUCUUGUUTT B | 2714 |
| R-008396319-000N | 2480 | 459 | GAGAUGGGUGGCCACCACC | B GAGAUGGGUGGCCACCACCTT B | 2716 |
| R-008396319-000N | 2480 | 459 | GAGAUGGGUGGCCACCACC | GGUGGUGGCCACCCAUCUCUU | 2717 |
| R-008396322-000V | 1856 | 460 | CAGGGUGCCAUUCCACGAC | B CAGGGUGCCAUUCCACGACTT B | 2718 |
| R-008396322-000V | 1856 | 460 | CAGGGUGCCAUUCCACGAC | GUCGUGGAAUGGCACCCUGUU | 2719 |
| R-008396325-000W | 2193 | 461 | AGUUACUUCACUCUAGGAA | B AGUUACUUCACUCUAGGAATT B | 2720 |
| R-008396325-000W | 2193 | 461 | AGUUACUUCACUCUAGGAA | UUCCUAGAGUGAAGUAACUUU | 2721 |
| R-008396328-000X | 2355 | 462 | UUGGACUUGAUAUUGGUGC | B UUGGACUUGAUAUUGGUGCTT B | 2722 |
| R-008396328-000X | 2355 | 462 | UUGGACUUGAUAUUGGUGC | GCACCAAUAUCAAGUCCAAUU | 2723 |
| R-008396331-000D | 1995 | 463 | CCCUUCACAUCCUAGCUCG | CGAGCUAGGAUGUGAAGGGUU | 2725 |
| R-008396331-000D | 1995 | 463 | CCCUUCACAUCCUAGCUCG | B CCCUUCACAUCCUAGCUCGTT B | 2724 |
| R-008396334-000E | 821 | 464 | AGACACGCUAUCAUGCGUU | B AGACACGCUAUCAUGCGUUTT B | 2726 |
| R-008396334-000E | 821 | 464 | AGACACGCUAUCAUGCGUU | AACGCAUGAUAGCGUGUCUUU | 2727 |
| R-008396337-000F | 1715 | 465 | AAUGCAGUUCGCCUUCACU | B AAUGCAGUUCGCCUUCACUTT B | 2728 |
| R-008396337-000F | 1715 | 465 | AAUGCAGUUCGCCUUCACU | AGUGAAGGCGAACUGCAUUUU | 2729 |
| R-008396340-000M | 1182 | 466 | CUUAUGGCAACCAAGAAAG | CUUUCUUGGUUGCCAUAAGUU | 2731 |
| R-008396340-000M | 1182 | 466 | CUUAUGGCAACCAAGAAAG | B CUUAUGGCAACCAAGAAAGTT B | 2730 |
| R-008396343-000N | 445 | 467 | CUCCCAAGUCCUGUAUGAG | B CUCCCAAGUCCUGUAUGAGTT B | 2732 |
| R-008396343-000N | 445 | 467 | CUCCCAAGUCCUGUAUGAG | CUCAUACAGGACUUGGGAGUU | 2733 |
| R-008396346-000P | 1759 | 468 | CUUACACCCACCAUCCCAC | GUGGGAUGGUGGGUGUAAGUU | 2735 |
| R-008396346-000P | 1759 | 468 | CUUACACCCACCAUCCCAC | B CUUACACCCACCAUCCCACTT B | 2734 |
| R-008396349-000R | 1461 | 469 | UGGAAGGUCUCCUUGGGAC | B UGGAAGGUCUCCUUGGGACTT B | 2736 |
| R-008396349-000R | 1461 | 469 | UGGAAGGUCUCCUUGGGAC | GUCCCAAGGAGACCUUCCAUU | 2737 |
| R-008396352-000X | 1993 | 470 | AGCCCUUCACAUCCUAGCU | AGCUAGGAUGUGAAGGGCUUU | 2739 |
| R-008396352-000X | 1993 | 470 | AGCCCUUCACAUCCUAGCU | B AGCCCUUCACAUCCUAGCUTT B | 2738 |
| R-008396355-000Y | 2558 | 471 | GAUGGGCUGCCUCCAGGUG | B GAUGGGCUGCCUCCAGGUGTT B | 2740 |
| R-008396355-000Y | 2558 | 471 | GAUGGGCUGCCUCCAGGUG | CACCUGGAGGCAGCCCAUCUU | 2741 |
| R-008396358-000Z | 1488 | 472 | AGCUUCGGGUUCAGAUGA | B AGCUUCGGGUUCAGAUGATT B | 2742 |
| R-008396358-000Z | 1488 | 472 | AGCUUCGGGUUCAGAUGA | UCAUCUGAACCCAGAAGCUUU | 2743 |
| R-008396361-000F | 1652 | 473 | GAGCCUGCCAUCUGUGCUC | B GAGCCUGCCAUCUGUGCUCTT B | 2744 |
| R-008396361-000F | 1652 | 473 | GAGCCUGCCAUCUGUGCUC | GAGCACAGAUGGCAGGCUCUU | 2745 |
| R-008396364-000G | 963 | 474 | UUAAGUCUGGAGGCAUUCC | B UUAAGUCUGGAGGCAUUCCTT B | 2746 |
| R-008396364-000G | 963 | 474 | UUAAGUCUGGAGGCAUUCC | GGAAUGCCUCCAGACUUAAUU | 2747 |
| R-008396367-000H | 1520 | 475 | ACCUGUGCAGCUGGAAUUC | B ACCUGUGCAGCUGGAAUUCTT B | 2748 |
| R-008396367-000H | 1520 | 475 | ACCUGUGCAGCUGGAAUUC | GAAUUCCAGCUGCACAGGUUU | 2749 |
| R-008396370-000P | 1828 | 476 | UCCCGCAAAUCAUGCACCU | AGGUGCAUGAUUUGCGGGAUU | 2751 |
| R-008396370-000P | 1828 | 476 | UCCCGCAAAUCAUGCACCU | B UCCCGCAAAUCAUGCACCUTT B | 2750 |
| R-008396373-000R | 2214 | 477 | AAGGUGUGGCGACAUAUGC | B AAGGUGUGGCGACAUAUGCTT B | 2752 |
| R-008396373-000R | 2214 | 477 | AAGGUGUGGCGACAUAUGC | GCAUAUGUCGCCACACCUUUU | 2753 |
| R-008396376-000S | 2155 | 478 | AGCUAUUGAAGCUGAGGGA | UCCCUCAGCUUCAAUAGCUUU | 2755 |
| R-008396376-000S | 2155 | 478 | AGCUAUUGAAGCUGAGGGA | B AGCUAUUGAAGCUGAGGGATT B | 2754 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396379-000T | 332 | 479 | GUUAGUCACUGGCAGCAAC | GUUGCUGCCAGUGACUAACUU | 2757 |
| R-008396379-000T | 332 | 479 | GUUAGUCACUGGCAGCAAC | B GUUAGUCACUGGCAGCAACTT B | 2756 |
| R-008396382-000Z | 2545 | 74 | CCAGGACCUCAUGGAUGGG | CCCAUCCAUGAGGUCCUGGUU | 2759 |
| R-008396382-000Z | 2545 | 74 | CCAGGACCUCAUGGAUGGG | B CCAGGACCUCAUGGAUGGGTT B | 2758 |
| R-008396385-000A | 1878 | 480 | UUCAGUUGCUUGUUCGUGC | B UUCAGUUGCUUGUUCGUGCTT B | 2760 |
| R-008396385-000A | 1878 | 480 | UUCAGUUGCUUGUUCGUGC | GCACGAACAAGCAACUGAAUU | 2761 |
| R-008396388-000B | 1789 | 106 | AAAGGCUACUGUUGGAUUG | CAAUCCAACAGUAGCCUUUUU | 2763 |
| R-008396388-000B | 1789 | 106 | AAAGGCUACUGUUGGAUUG | B AAAGGCUACUGUUGGAUUGTT B | 2762 |
| R-008396391-000H | 2547 | 168 | AGGACCUCAUGGAUGGGCU | B AGGACCUCAUGGAUGGGCUTT B | 2764 |
| R-008396391-000H | 2547 | 168 | AGGACCUCAUGGAUGGGCU | AGCCCAUCCAUGAGGUCCUUU | 2765 |
| R-008396394-000J | 1573 | 481 | GAUGAUGGUCUGCCAAGUG | B GAUGAUGGUCUGCCAAGUGTT B | 2766 |
| R-008396394-000J | 1573 | 481 | GAUGAUGGUCUGCCAAGUG | CACUUGGCAGACCAUCAUCUU | 2767 |
| R-008396397-000K | 1446 | 482 | CUAAACAGGAAGGGAUGGA | B CUAAACAGGAAGGGAUGGATT B | 2768 |
| R-008396397-000K | 1446 | 482 | CUAAACAGGAAGGGAUGGA | UCCAUCCCUUCCUGUUUAGUU | 2769 |
| R-008396400-000C | 1868 | 483 | CCACGACUAGUUCAGUUGC | GCAACUGAACUAGUCGUGGUU | 2771 |
| R-008396400-000C | 1868 | 483 | CCACGACUAGUUCAGUUGC | B CCACGACUAGUUCAGUUGCTT B | 2770 |
| R-008396403-000D | 1873 | 484 | ACUAGUUCAGUUGCUUGUU | AACAAGCAACUGAACUAGUUU | 2773 |
| R-008396403-000D | 1873 | 484 | ACUAGUUCAGUUGCUUGUU | B ACUAGUUCAGUUGCUUGUUTT B | 2772 |
| R-008396406-000E | 1002 | 485 | GUUCACCAGUGGAUUCUGU | B GUUCACCAGUGGAUUCUGUTT B | 2774 |
| R-008396406-000E | 1002 | 485 | GUUCACCAGUGGAUUCUGU | ACAGAAUCCACUGGUGAACUU | 2775 |
| R-008396409-000F | 408 | 486 | GUGGUAAAGGCAAUCCUGA | B GUGGUAAAGGCAAUCCUGATT B | 2776 |
| R-008396409-000F | 408 | 486 | GUGGUAAAGGCAAUCCUGA | UCAGGAUUGCCUUUACCACUU | 2777 |
| R-008396412-000M | 287 | 487 | UUGAUGGAGUUGGACAUGG | CCAUGUCCAACUCCAUCAAUU | 2779 |
| R-008396412-000M | 287 | 487 | UUGAUGGAGUUGGACAUGG | B UUGAUGGAGUUGGACAUGGTT B | 2778 |
| R-008396415-000N | 1492 | 119 | UCUGGGUUCAGAUGAUAUA | UAUAUCAUCUGAACCCAGAUU | 2781 |
| R-008396415-000N | 1492 | 119 | UCUGGGUUCAGAUGAUAUA | B UCUGGGUUCAGAUGAUAUATT B | 2780 |
| R-008396418-000P | 517 | 187 | UGGACAGUAUGCAAUGACU | B UGGACAGUAUGCAAUGACUTT B | 2782 |
| R-008396418-000P | 517 | 187 | UGGACAGUAUGCAAUGACU | AGUCAUUGCAUACUGUCCAUU | 2783 |
| R-008396421-000W | 447 | 177 | CCCAAGUCCUGUAUGAGUG | B CCCAAGUCCUGUAUGAGUGTT B | 2784 |
| R-008396421-000W | 447 | 177 | CCCAAGUCCUGUAUGAGUG | CACUCAUACAGGACUUGGGUU | 2785 |
| R-008396424-000X | 2128 | 488 | ACUUGCUCAGGACAAGGAA | UUCCUUGUCCUGAGCAAGUUU | 2787 |
| R-008396424-000X | 2128 | 488 | ACUUGCUCAGGACAAGGAA | B ACUUGCUCAGGACAAGGAATT B | 2786 |
| R-008396427-000Y | 2513 | 489 | CCAGUUGAUGGGCUGCCAG | B CCAGUUGAUGGGCUGCCAGTT B | 2788 |
| R-008396427-000Y | 2513 | 489 | CCAGUUGAUGGGCUGCCAG | CUGGCAGCCCAUCAACUGGUU | 2789 |
| R-008396430-000E | 1196 | 490 | GAAAGCAAGCUCAUCAUAC | GUAUGAUGAGCUUGCUUUCUU | 2791 |
| R-008396430-000E | 1196 | 490 | GAAAGCAAGCUCAUCAUAC | B GAAAGCAAGCUCAUCAUACTT B | 2790 |
| R-008396433-000F | 572 | 491 | ACAUUAGAUGAGGGCAUGC | B ACAUUAGAUGAGGGCAUGCTT B | 2792 |
| R-008396433-000F | 572 | 491 | ACAUUAGAUGAGGGCAUGC | GCAUGCCCUCAUCUAAUGUUU | 2793 |
| R-008396436-000G | 622 | 492 | UCCCACUAAUGUCCAGCGU | B UCCCACUAAUGUCCAGCGUTT B | 2794 |
| R-008396436-000G | 622 | 492 | UCCCACUAAUGUCCAGCGU | ACGCUGGACAUUAGUGGGAUU | 2795 |
| R-008396439-000H | 1187 | 493 | GGCAACCAAGAAAGCAAGC | GCUUGCUUUCUUGGUUGCCUU | 2797 |
| R-008396439-000H | 1187 | 493 | GGCAACCAAGAAAGCAAGC | B GGCAACCAAGAAAGCAAGCTT B | 2796 |
| R-008396442-000P | 2098 | 49 | CCAAAGAGUAGCUGCAGGG | B CCAAAGAGUAGCUGCAGGGTT B | 2798 |
| R-008396442-000P | 2098 | 49 | CCAAAGAGUAGCUGCAGGG | CCCUGCAGCUACUCUUUGGUU | 2799 |
| R-008396445-000R | 1971 | 494 | AAAUAGUUGAAGGUUGUAC | B AAAUAGUUGAAGGUUGUACTT B | 2800 |
| R-008396445-000R | 1971 | 494 | AAAUAGUUGAAGGUUGUAC | GUACAACCUUCAACUAUUUUU | 2801 |
| R-008396448-000S | 3083 | 495 | GGAUAUGUAUGGGUAGGGU | ACCCUACCCAUACAUAUCCUU | 2803 |
| R-008396448-000S | 3083 | 495 | GGAUAUGUAUGGGUAGGGU | B GGAUAUGUAUGGGUAGGGUTT B | 2802 |
| R-008396454-000Z | 2944 | 496 | UAAUCUGAAUAAAGUGUAA | UUACACUUUAUUCAGAUUAUU | 2805 |
| R-008396454-000Z | 2944 | 496 | UAAUCUGAAUAAAGUGUAA | B UAAUCUGAAUAAAGUGUAATT B | 2804 |
| R-008396457-000A | 1894 | 497 | UGCACAUCAGGAUACCCAG | B UGCACAUCAGGAUACCCAGTT B | 2806 |
| R-008396457-000A | 1894 | 497 | UGCACAUCAGGAUACCCAG | CUGGGUAUCCUGAUGUGCAUU | 2807 |
| R-008396460-000G | 1323 | 498 | GUAAUAGCCGGCUAUUGU | B GUAAUAAGCCGGCUAUUGUTT B | 2808 |
| R-008396460-000G | 1323 | 498 | GUAAUAGCCGGCUAUUGU | ACAAUAGCCGGCUUAUUACUU | 2809 |
| R-008396469-000K | 1202 | 499 | AAGCUCAUCAUACUGGCUA | B AAGCUCAUCAUACUGGCUATT B | 2810 |
| R-008396469-000K | 1202 | 499 | AAGCUCAUCAUACUGGCUA | UAGCCAGUAUGAUGAGCUUUU | 2811 |
| R-008396472-000S | 718 | 500 | ACGUGCAAUCCCUGAACUG | CAGUUCAGGGAUUGCACGUUU | 2813 |
| R-008396472-000S | 718 | 500 | ACGUGCAAUCCCUGAACUG | B ACGUGCAAUCCCUGAACUGTT B | 2812 |
| R-008396475-000T | 2097 | 46 | UCCAAAGAGUAGCUGCAGG | CCUGCAGCUACUCUUUGGAUU | 2815 |
| R-008396475-000T | 2097 | 46 | UCCAAAGAGUAGCUGCAGG | B UCCAAAGAGUAGCUGCAGGTT B | 2814 |
| R-008396478-000U | 1744 | 501 | AGUUGUGGUUAAGCUCUUA | B AGUUGUGGUUAAGCUCUUATT B | 2816 |
| R-008396478-000U | 1744 | 501 | AGUUGUGGUUAAGCUCUUA | UAAGAGCUUAACCACAACUUU | 2817 |
| R-008396481-000A | 756 | 502 | AGGACCAGGUGGUGGUUAA | UUAACCACCACCUGGUCCUUU | 2819 |
| R-008396481-000A | 756 | 502 | AGGACCAGGUGGUGGUUAA | B AGGACCAGGUGGUGGUUAATT B | 2818 |
| R-008396484-000B | 1317 | 503 | GCUCUAGUAAUAAGCCGGC | GCCGGCUUAUUACUAGAGCUU | 2821 |
| R-008396484-000B | 1317 | 503 | GCUCUAGUAAUAAGCCGGC | B GCUCUAGUAAUAAGCCGGCTT B | 2820 |
| R-008396487-000C | 284 | 504 | GAUUUGAUGGAGUUGGACA | B GAUUUGAUGGAGUUGGACATT B | 2822 |
| R-008396487-000C | 284 | 504 | GAUUUGAUGGAGUUGGACA | UGUCCAACUCCAUCAAAUCUU | 2823 |
| R-008396490-000J | 886 | 505 | UGAUGUAGAAACAGCUCGU | B UGAUGUAGAAACAGCUCGUTT B | 2824 |
| R-008396490-000J | 886 | 505 | UGAUGUAGAAACAGCUCGU | ACGAGCUGUUUCUACAUCAUU | 2825 |
| R-008396493-000K | 2430 | 506 | CUGGUGGAUAUGGCCAGGA | B CUGGUGGAUAUGGCCAGGATT B | 2826 |
| R-008396493-000K | 2430 | 506 | CUGGUGGAUAUGGCCAGGA | UCCUGGCCAUAUCCACCAGUU | 2827 |
| R-008396496-000L | 1207 | 507 | CAUCAUACUGGCUAGUGGU | B CAUCAUACUGGCUAGUGGUTT B | 2828 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396496-000L | 1207 | 507 | CAUCAUACUGGCUAGUGGU | ACCACUAGCCAGUAUGAUGUU | 2829 |
| R-008396499-000M | 592 | 508 | GAUCCCAUCUACACAGUUU | AAACUGUGUAGAUGGGAUCUU | 2831 |
| R-008396499-000M | 592 | 508 | GAUCCCAUCUACACAGUUU | B GAUCCCAUCUACACAGUUUTT B | 2830 |
| R-008396502-000E | 824 | 509 | CACGCUAUCAUGCGUUCUC | GAGAACGCAUGAUAGCGUGUU | 2833 |
| R-008396502-000E | 824 | 509 | CACGCUAUCAUGCGUUCUC | B CACGCUAUCAUGCGUUCUCTT B | 2832 |
| R-008396505-000F | 519 | 510 | GACAGUAUGCAAUGACUCG | B GACAGUAUGCAAUGACUCGTT B | 2834 |
| R-008396505-000F | 519 | 510 | GACAGUAUGCAAUGACUCG | CGAGUCAUUGCAUACUGUCUU | 2835 |
| R-008396508-000G | 3166 | 511 | AAGUUGUUGUAACCUGCUG | CAGCAGGUUACAACAACUUUU | 2837 |
| R-008396508-000G | 3166 | 511 | AAGUUGUUGUAACCUGCUG | B AAGUUGUUGUAACCUGCUGTT B | 2836 |
| R-008396511-000N | 1151 | 512 | GCUAUUACGACAGACUGCC | B GCUAUUACGACAGACUGCCTT B | 2838 |
| R-008396511-000N | 1151 | 512 | GCUAUUACGACAGACUGCC | GGCAGUCUGUCGUAAUAGCUU | 2839 |
| R-008396514-000P | 2566 | 513 | GCCUCCAGGUGACAGCAAU | B GCCUCCAGGUGACAGCAAUTT B | 2840 |
| R-008396514-000P | 2566 | 513 | GCCUCCAGGUGACAGCAAU | AUUGCUGUCACCUGGAGGCUU | 2841 |
| R-008396517-000R | 453 | 514 | UCCUGUAUGAGUGGGAACA | UGUUCCCACUCAUACAGGAUU | 2843 |
| R-008396517-000R | 453 | 514 | UCCUGUAUGAGUGGGAACA | B UCCUGUAUGAGUGGGAACATT B | 2842 |
| R-008396520-000X | 587 | 515 | AUGCAGAUCCCAUCUACAC | GUGUAGAUGGGAUCUGCAUUU | 2845 |
| R-008396520-000X | 587 | 515 | AUGCAGAUCCCAUCUACAC | B AUGCAGAUCCCAUCUACACTT B | 2844 |
| R-008396523-000Y | 930 | 516 | UUUCCCAUCAUCGUGAGGG | B UUUCCCAUCAUCGUGAGGGTT B | 2846 |
| R-008396523-000Y | 930 | 516 | UUUCCCAUCAUCGUGAGGG | CCCUCACGAUGAUGGGAAAUU | 2847 |
| R-008396526-000Z | 1585 | 517 | CCAAGUGGGUGGUAUAGAG | B CCAAGUGGGUGGUAUAGAGTT B | 2848 |
| R-008396526-000Z | 1585 | 517 | CCAAGUGGGUGGUAUAGAG | CUCUAUACCACCCACUUGGUU | 2849 |
| R-008396529-000A | 915 | 518 | GGACCUUGCAUAACCUUUC | B GGACCUUGCAUAACCUUUCTT B | 2850 |
| R-008396529-000A | 915 | 518 | GGACCUUGCAUAACCUUUC | GAAAGGUUAUGCAAGGUCCUU | 2851 |
| R-008396532-000G | 446 | 519 | UCCCAAGUCCUGUAUGAGU | ACUCAUACAGGACUUGGGAUU | 2853 |
| R-008396532-000G | 446 | 519 | UCCCAAGUCCUGUAUGAGU | B UCCCAAGUCCUGUAUGAGUTT B | 2852 |
| R-008396535-000H | 1869 | 520 | CACGACUAGUUCAGUUGCU | AGCAACUGAACUAGUCGUGUU | 2855 |
| R-008396535-000H | 1869 | 520 | CACGACUAGUUCAGUUGCU | B CACGACUAGUUCAGUUGCUTT B | 2854 |
| R-008396538-000J | 1960 | 521 | CCGCAUGGAAGAAAUAGUU | AACUAUUUCUUCCAUGCGGUU | 2857 |
| R-008396538-000J | 1960 | 521 | CCGCAUGGAAGAAAUAGUU | B CCGCAUGGAAGAAAUAGUUTT B | 2856 |
| R-008396541-000R | 1708 | 522 | GGCCCAGAAUGCAGUUCGC | B GGCCCAGAAUGCAGUUCGCTT B | 2858 |
| R-008396541-000R | 1708 | 522 | GGCCCAGAAUGCAGUUCGC | GCGAACUGCAUUCUGGGCCUU | 2859 |
| R-008396544-000S | 306 | 523 | CCAUGGAACCAGACAGAAA | UUUCUGUCUGGUUCCAUGGUU | 2861 |
| R-008396544-000S | 306 | 523 | CCAUGGAACCAGACAGAAA | B CCAUGGAACCAGACAGAAATT B | 2860 |
| R-008396550-000Z | 2281 | 524 | GAAACGGCUUUCAGUUGAG | B GAAACGGCUUUCAGUUGAGTT B | 2862 |
| R-008396550-000Z | 2281 | 524 | GAAACGGCUUUCAGUUGAG | CUCAACUGAAAGCCGUUUCUU | 2863 |
| R-008396553-000A | 3082 | 525 | GGGAUAUGUAUGGGUAGGG | B GGGAUAUGUAUGGGUAGGGTT B | 2864 |
| R-008396553-000A | 3082 | 525 | GGGAUAUGUAUGGGUAGGG | CCCUACCCAUACAUAUCCCUU | 2865 |
| R-008396556-000B | 1473 | 526 | UUGGGACUCUUGUUCAGCU | AGCUGAACAAGAGUCCCAAUU | 2867 |
| R-008396556-000B | 1473 | 526 | UUGGGACUCUUGUUCAGCU | B UUGGGACUCUUGUUCAGCUTT B | 2866 |
| R-008396559-000C | 559 | 527 | UAUGUUCCCUGAGACAUUA | UAAUGUCUCAGGGAACAUAUU | 2869 |
| R-008396559-000C | 559 | 527 | UAUGUUCCCUGAGACAUUA | B UAUGUUCCCUGAGACAUUATT B | 2868 |
| R-008396562-000J | 1416 | 528 | GGACUCUCAGGAAUCUUUC | B GGACUCUCAGGAAUCUUUCTT B | 2870 |
| R-008396562-000J | 1416 | 528 | GGACUCUCAGGAAUCUUUC | GAAAGAUUCCUGAGAGUCCUU | 2871 |
| R-008396565-000K | 2145 | 529 | AAGCUGCAGAAGCUAUUGA | B AAGCUGCAGAAGCUAUUGATT B | 2872 |
| R-008396565-000K | 2145 | 529 | AAGCUGCAGAAGCUAUUGA | UCAAUAGCUUCUGCAGCUUUU | 2873 |
| R-008396568-000L | 1994 | 530 | GCCCUUCACAUCCUAGCUC | B GCCCUUCACAUCCUAGCUCTT B | 2874 |
| R-008396568-000L | 1994 | 530 | GCCCUUCACAUCCUAGCUC | GAGCUAGGAUGUGAAGGGCUU | 2875 |
| R-008396571-000T | 1611 | 27 | UGCGUACUGUCCUUCGGGC | B UGCGUACUGUCCUUCGGGCTT B | 2876 |
| R-008396571-000T | 1611 | 27 | UGCGUACUGUCCUUCGGGC | GCCCGAAGGACAGUACGCAUU | 2877 |
| R-008396574-000U | 1702 | 531 | AGAGAUGGCCCAGAAUGCA | B AGAGAUGGCCCAGAAUGCATT B | 2878 |
| R-008396574-000U | 1702 | 531 | AGAGAUGGCCCAGAAUGCA | UGCAUUCUGGGCCAUCUCUUU | 2879 |
| R-008396577-000V | 417 | 532 | GCAAUCCUGAGGAAGAGGA | B GCAAUCCUGAGGAAGAGGATT B | 2880 |
| R-008396577-000V | 417 | 532 | GCAAUCCUGAGGAAGAGGA | UCCUCUUCCUCAGGAUUGCUU | 2881 |
| R-008396580-000B | 2444 | 533 | CAGGAUGCCUUGGGUAUGG | B CAGGAUGCCUUGGGUAUGGTT B | 2882 |
| R-008396580-000B | 2444 | 533 | CAGGAUGCCUUGGGUAUGG | CCAUACCCAAGGCAUCCUGUU | 2883 |
| R-008396586-000D | 555 | 534 | CUGCUAUGUUCCCUGAGAC | B CUGCUAUGUUCCCUGAGACTT B | 2884 |
| R-008396586-000D | 555 | 534 | CUGCUAUGUUCCCUGAGAC | GUCUCAGGGAACAUAGCAGUU | 2885 |
| R-008396589-000E | 2019 | 535 | UUCACAACCGAAUUGUUAU | B UUCACAACCGAAUUGUUAUTT B | 2886 |
| R-008396589-000E | 2019 | 535 | UUCACAACCGAAUUGUUAU | AUAACAAUUCGGUUGUGAAUU | 2887 |
| R-008396592-000L | 1197 | 536 | AAAGCAAGCUCAUCAUACU | B AAAGCAAGCUCAUCAUACUTT B | 2888 |
| R-008396592-000L | 1197 | 536 | AAAGCAAGCUCAUCAUACU | AGUAUGAUGAGCUUGCUUUUU | 2889 |
| R-008396595-000M | 415 | 537 | AGGCAAUCCUGAGGAAGAG | CUCUUCCUCAGGAUUGCCUUU | 2891 |
| R-008396595-000M | 415 | 537 | AGGCAAUCCUGAGGAAGAG | B AGGCAAUCCUGAGGAAGAGTT B | 2890 |
| R-008396598-000N | 2061 | 538 | UGUUUGUGCAGCUGCUUUA | B UGUUUGUGCAGCUGCUUUATT B | 2892 |
| R-008396598-000N | 2061 | 538 | UGUUUGUGCAGCUGCUUUA | UAAAGCAGCUGCACAAACAUU | 2893 |
| R-008396601-000F | 1352 | 539 | GGAAUGCAAGCUUUAGGAC | B GGAAUGCAAGCUUUAGGACTT B | 2894 |
| R-008396601-000F | 1352 | 539 | GGAAUGCAAGCUUUAGGAC | GUCCUAAAGCUUGCAUUCCUU | 2895 |
| R-008396604-000G | 1502 | 135 | GAUGAUAUAAAUGUGGUCA | UGACCACAUUUAUAUCAUCUU | 2897 |
| R-008396604-000G | 1502 | 135 | GAUGAUAUAAAUGUGGUCA | B GAUGAUAUAAAUGUGGUCATT B | 2896 |
| R-008396607-000H | 1331 | 540 | CCGGCUAUUGUAGAAGCUG | B CCGGCUAUUGUAGAAGCUGTT B | 2898 |
| R-008396607-000H | 1331 | 540 | CCGGCUAUUGUAGAAGCUG | CAGCUUCUACAAUAGCCGGUU | 2899 |
| R-008396610-000P | 1325 | 541 | AAUAAGCCGGCUAUUGUAG | B AAUAAGCCGGCUAUUGUAGTT B | 2900 |
| R-008396610-000P | 1325 | 541 | AAUAAGCCGGCUAUUGUAG | CUACAAUAGCCGGCUUAUUUU | 2901 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396613-000R | 1486 | 542 | UCAGCUUCUGGGUUCAGAU | B UCAGCUUCUGGGUUCAGAUTT B | 2902 |
| R-008396613-000R | 1486 | 542 | UCAGCUUCUGGGUUCAGAU | AUCUGAACCCAGAAGCUGAUU | 2903 |
| R-008396616-000S | 454 | 543 | CCUGUAUGAGUGGGAACAG | B CCUGUAUGAGUGGGAACAGTT B | 2904 |
| R-008396616-000S | 454 | 543 | CCUGUAUGAGUGGGAACAG | CUGUUCCCACUCAUACAGGUU | 2905 |
| R-008396619-000T | 490 | 544 | CACUCAAGAACAAGUAGCU | B CACUCAAGAACAAGUAGCUTT B | 2906 |
| R-008396619-000T | 490 | 544 | CACUCAAGAACAAGUAGCU | AGCUACUUGUUCUUGAGUGUU | 2907 |
| R-008396622-000Z | 1996 | 545 | CCUUCACAUCCUAGCUCGG | B CCUUCACAUCCUAGCUCGGTT B | 2908 |
| R-008396622-000Z | 1996 | 545 | CCUUCACAUCCUAGCUCGG | CCGAGCUAGGAUGUGAAGGUU | 2909 |
| R-008396625-000A | 1839 | 546 | AUGCACCUUUGCGUGAGCA | B AUGCACCUUUGCGUGAGCATT B | 2910 |
| R-008396625-000A | 1839 | 546 | AUGCACCUUUGCGUGAGCA | UGCUCACGCAAAGGUGCAUUU | 2911 |
| R-008396628-000B | 1888 | 547 | UGUUCGUGCACAUCAGGAU | AUCCUGAUGUGCACGAACAUU | 2913 |
| R-008396628-000B | 1888 | 547 | UGUUCGUGCACAUCAGGAU | B UGUUCGUGCACAUCAGGAUTT B | 2912 |
| R-008396631-000H | 1879 | 548 | UCAGUUGCUUGUUCGUGCA | B UCAGUUGCUUGUUCGUGCATT B | 2914 |
| R-008396631-000H | 1879 | 548 | UCAGUUGCUUGUUCGUGCA | UGCACGAACAAGCAACUGAUU | 2915 |
| R-008396634-000J | 2508 | 172 | ACUAUCCAGUUGAUGGGCU | B ACUAUCCAGUUGAUGGGCUTT B | 2916 |
| R-008396634-000J | 2508 | 172 | ACUAUCCAGUUGAUGGGCU | AGCCCAUCAACUGGAUAGUUU | 2917 |
| R-008396637-000K | 1829 | 549 | CCCGCAAAUCAUGCACCUU | AAGGUGCAUGAUUUGCGGGUU | 2919 |
| R-008396637-000K | 1829 | 549 | CCCGCAAAUCAUGCACCUU | B CCCGCAAAUCAUGCACCUUTT B | 2918 |
| R-008396640-000S | 281 | 550 | GCUGAUUUGAUGGAGUUGG | B GCUGAUUUGAUGGAGUUGGTT B | 2920 |
| R-008396640-000S | 281 | 550 | GCUGAUUUGAUGGAGUUGG | CCAACUCCAUCAAAUCAGCUU | 2921 |
| R-008396643-000T | 1598 | 551 | AUAGAGGCUCUUGUGCGUA | UACGCACAAGAGCCUCUAUUU | 2923 |
| R-008396643-000T | 1598 | 551 | AUAGAGGCUCUUGUGCGUA | B AUAGAGGCUCUUGUGCGUATT B | 2922 |
| R-008396646-000U | 2135 | 552 | CAGGACAAGGAAGCUGCAG | B CAGGACAAGGAAGCUGCAGTT B | 2924 |
| R-008396646-000U | 2135 | 552 | CAGGACAAGGAAGCUGCAG | CUGCAGCUUCCUUGUCCUGUU | 2925 |
| R-008396649-000V | 642 | 67 | UGGCUGAACCAUCACAGAU | AUCUGUGAUGGUUCAGCCAUU | 2927 |
| R-008396649-000V | 642 | 67 | UGGCUGAACCAUCACAGAU | B UGGCUGAACCAUCACAGAUTT B | 2926 |
| R-008396652-000B | 1755 | 553 | AGCUCUUACACCCACCAUC | B AGCUCUUACACCCACCAUCTT B | 2928 |
| R-008396652-000B | 1755 | 553 | AGCUCUUACACCCACCAUC | GAUGGUGGGUGUAAGAGCUUU | 2929 |
| R-008396655-000C | 651 | 554 | CAUCACAGAUGCUGAAACA | B CAUCACAGAUGCUGAAACATT B | 2930 |
| R-008396655-000C | 651 | 554 | CAUCACAGAUGCUGAAACA | UGUUUCAGCAUCUGUGAUGUU | 2931 |
| R-008396658-000D | 1335 | 555 | CUAUUGUAGAAGCUGGUGG | C CACCAGCUUCUACAAUAGUU | 2933 |
| R-008396658-000D | 1335 | 555 | CUAUUGUAGAAGCUGGUGG | B CUAUUGUAGAAGCUGGUGGTT B | 2932 |
| R-008396661-000K | 2541 | 556 | AUGCCCAGGACCUCAUGGA | UCCAUGAGGUCCUGGGCAUUU | 2935 |
| R-008396661-000K | 2541 | 556 | AUGCCCAGGACCUCAUGGA | B AUGCCCAGGACCUCAUGGATT B | 2934 |
| R-008396664-000L | 531 | 557 | UGACUCGAGCUCAGAGGGU | B UGACUCGAGCUCAGAGGGUTT B | 2936 |
| R-008396664-000L | 531 | 557 | UGACUCGAGCUCAGAGGGU | ACCCUCUGAGCUCGAGUCAUU | 2937 |
| R-008396667-000M | 606 | 558 | AGUUUGAUGCUGCUCAUCC | B AGUUUGAUGCUGCUCAUCCTT B | 2938 |
| R-008396667-000M | 606 | 558 | AGUUUGAUGCUGCUCAUCC | GGAUGAGCAGCAUCAAACUUU | 2939 |
| R-008396670-000U | 1620 | 559 | UCCUUCGGGCUGGUGACAG | B UCCUUCGGGCUGGUGACAGTT B | 2940 |
| R-008396670-000U | 1620 | 559 | UCCUUCGGGCUGGUGACAG | CUGUCACCAGCCCGAAGGAUU | 2941 |
| R-008396673-000V | 2211 | 560 | AUGAAGGUGUGGCGACAUA | B AUGAAGGUGUGGCGACAUATT B | 2942 |
| R-008396673-000V | 2211 | 560 | AUGAAGGUGUGGCGACAUA | UAUGUCGCCACACCUUCAUUU | 2943 |
| R-008396676-000W | 2293 | 561 | AGUUGAGCUGACCAGCUCU | B AGUUGAGCUGACCAGCUCUTT B | 2944 |
| R-008396676-000W | 2293 | 561 | AGUUGAGCUGACCAGCUCU | AGAGCUGGUCAGCUCAACUU | 2945 |
| R-008396679-000X | 1511 | 65 | AAUGUGGUCACCUGUGCAG | B AAUGUGGUCACCUGUGCAGTT B | 2946 |
| R-008396679-000X | 1511 | 65 | AAUGUGGUCACCUGUGCAG | CUGCACAGGUGACCACAUUUU | 2947 |
| R-008396682-000D | 455 | 562 | CUGUAUGAGUGGGAACAGG | B CUGUAUGAGUGGGAACAGGTT B | 2948 |
| R-008396682-000D | 455 | 562 | CUGUAUGAGUGGGAACAGG | CCUGUUCCCACUCAUACAGUU | 2949 |
| R-008396685-000E | 540 | 563 | CUCAGAGGGUACGAGCUGC | B CUCAGAGGGUACGAGCUGCTT B | 2950 |
| R-008396685-000E | 540 | 563 | CUCAGAGGGUACGAGCUGC | GCAGCUCGUACCCUCUGAGUU | 2951 |
| R-008396688-000F | 416 | 564 | GGCAAUCCUGAGGAAGAGG | CCUCUUCCUCAGGAUUGCCUU | 2953 |
| R-008396688-000F | 416 | 564 | GGCAAUCCUGAGGAAGAGG | B GGCAAUCCUGAGGAAGAGGTT B | 2952 |
| R-008396691-000M | 1669 | 130 | UCUUCGUCAUCUGACCAGC | GCUGGUCAGAUGACGAAGAUU | 2955 |
| R-008396691-000M | 1669 | 130 | UCUUCGUCAUCUGACCAGC | B UCUUCGUCAUCUGACCAGCTT B | 2954 |
| R-008396694-000N | 1210 | 565 | CAUACUGGCUAGUGGUGGA | B CAUACUGGCUAGUGGUGGATT B | 2956 |
| R-008396694-000N | 1210 | 565 | CAUACUGGCUAGUGGUGGA | UCCACCACUAGCCAGUAUGUU | 2957 |
| R-008396697-000P | 2262 | 566 | ACAAGCCACAAGAUUACAA | UUGUAAUCUUGUGGCUUGUUU | 2959 |
| R-008396697-000P | 2262 | 566 | ACAAGCCACAAGAUUACAA | B ACAAGCCACAAGAUUACAATT B | 2958 |
| R-008396700-000G | 1604 | 567 | GCUCUUGUGCGUACUGUCC | GGACAGUACGCACAAGAGCUU | 2961 |
| R-008396700-000G | 1604 | 567 | GCUCUUGUGCGUACUGUCC | B GCUCUUGUGCGUACUGUCCTT B | 2960 |
| R-008396703-000H | 435 | 568 | AUGUGGAUACCUCCCAAGU | B AUGUGGAUACCUCCCAAGUTT B | 2962 |
| R-008396703-000H | 435 | 568 | AUGUGGAUACCUCCCAAGU | ACUUGGGAGGUAUCCACAUUU | 2963 |
| R-008396706-000J | 2060 | 569 | UUGUUUGUGCAGCUGCUUU | B UUGUUUGUGCAGCUGCUUUTT B | 2964 |
| R-008396706-000J | 2060 | 569 | UUGUUUGUGCAGCUGCUUU | AAAGCAGCUGCACAAACAAUU | 2965 |
| R-008396709-000K | 2225 | 570 | ACAUAUGCAGCUGCUGUUU | B ACAUAUGCAGCUGCUGUUUTT B | 2966 |
| R-008396709-000K | 2225 | 570 | ACAUAUGCAGCUGCUGUUU | AAACAGCAGCUGCAUAUGUUU | 2967 |
| R-008396712-000S | 2510 | 47 | UAUCCAGUUGAUGGGCUGC | B UAUCCAGUUGAUGGGCUGCTT B | 2968 |
| R-008396712-000S | 2510 | 47 | UAUCCAGUUGAUGGGCUGC | GCAGCCCAUCAACUGGAUAUU | 2969 |
| R-008396715-000T | 481 | 571 | UCAGUCCUUCACUCAAGAA | UUCUUGAGUGAAGGACUGAUU | 2971 |
| R-008396715-000T | 481 | 571 | UCAGUCCUUCACUCAAGAA | B UCAGUCCUUCACUCAAGAATT B | 2970 |
| R-008396718-000U | 917 | 572 | ACCUUGCAUAACCUUUCCC | B ACCUUGCAUAACCUUUCCCTT B | 2972 |
| R-008396718-000U | 917 | 572 | ACCUUGCAUAACCUUUCCC | GGGAAAGGUUAUGCAAGGUUU | 2973 |
| R-008396721-000A | 2221 | 573 | GGCGACAUAUGCAGCUGCU | B GGCGACAUAUGCAGCUGCUTT B | 2974 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396721-000A | 2221 | 573 | GGCGACAUAUGCAGCUGCU | AGCAGCUGCAUAUGUCGCCUU | 2975 |
| R-008396724-000B | 849 | 574 | UGGUGUCUGCUAUUGUACG | CGUACAAUAGCAGACACCAUU | 2977 |
| R-008396724-000B | 849 | 574 | UGGUGUCUGCUAUUGUACG | B UGGUGUCUGCUAUUGUACGTT B | 2976 |
| R-008396727-000C | 562 | 575 | GUUCCCUGAGACAUUAGAU | B GUUCCCUGAGACAUUAGAUTT B | 2978 |
| R-008396727-000C | 562 | 575 | GUUCCCUGAGACAUUAGAU | AUCUAAUGUCUCAGGGAACUU | 2979 |
| R-008396730-000J | 617 | 140 | GCUCAUCCCACUAAUGUCC | GGACAUUAGUGGGAUGAGCUU | 2981 |
| R-008396730-000J | 617 | 140 | GCUCAUCCCACUAAUGUCC | B GCUCAUCCCACUAAUGUCCTT B | 2980 |
| R-008396733-000K | 1787 | 576 | AUAAAGGCUACUGUUGGAU | B AUAAAGGCUACUGUUGGAUTT B | 2982 |
| R-008396733-000K | 1787 | 576 | AUAAAGGCUACUGUUGGAU | AUCCAACAGUAGCCUUUAUUU | 2983 |
| R-008396736-000L | 1860 | 577 | GUGCCAUUCCACGACUAGU | ACUAGUCGUGGAAUGGCACUU | 2985 |
| R-008396736-000L | 1860 | 577 | GUGCCAUUCCACGACUAGU | B GUGCCAUUCCACGACUAGUTT B | 2984 |
| R-008396739-000M | 1590 | 578 | UGGGUGGUAUAGAGGCUCU | B UGGGUGGUAUAGAGGCUCUTT B | 2986 |
| R-008396739-000M | 1590 | 578 | UGGGUGGUAUAGAGGCUCU | AGAGCCUCUAUACCACCCAUU | 2987 |
| R-008396742-000U | 955 | 579 | GGCCAUCUUUAAGUCUGGA | UCCAGACUUAAAGAUGGCCUU | 2989 |
| R-008396742-000U | 955 | 579 | GGCCAUCUUUAAGUCUGGA | B GGCCAUCUUUAAGUCUGGATT B | 2988 |
| R-008396745-000V | 2365 | 580 | UAUUGGUGCCCAGGGAGAA | B UAUUGGUGCCCAGGGAGAATT B | 2990 |
| R-008396745-000V | 2365 | 580 | UAUUGGUGCCCAGGGAGAA | UUCUCCCUGGGCACCAAUAUU | 2991 |
| R-008396748-000W | 534 | 581 | CUCGAGCUCAGAGGGUACG | B CUCGAGCUCAGAGGGUACGTT B | 2992 |
| R-008396748-000W | 534 | 581 | CUCGAGCUCAGAGGGUACG | CGUACCCUCUGAGCUCGAGUU | 2993 |
| R-008396751-000C | 706 | 582 | AGAACUUGCCACACGUGCA | UGCACGUGUGGCAAGUUCUUU | 2995 |
| R-008396751-000C | 706 | 582 | AGAACUUGCCACACGUGCA | B AGAACUUGCCACACGUGCATT B | 2994 |
| R-008396754-000D | 1740 | 583 | UACCAGUUGUGGUUAAGCU | B UACCAGUUGUGGUUAAGCUTT B | 2996 |
| R-008396754-000D | 1740 | 583 | UACCAGUUGUGGUUAAGCU | AGCUUAACCACAACUGGUAUU | 2997 |
| R-008396757-000E | 638 | 584 | CGUUUGGCUGAACCAUCAC | B CGUUUGGCUGAACCAUCACTT B | 2998 |
| R-008396757-000E | 638 | 584 | CGUUUGGCUGAACCAUCAC | GUGAUGGUUCAGCCAAACGUU | 2999 |
| R-008396760-000L | 1334 | 585 | GCUAUUGUAGAAGCUGGUG | CACCAGCUUCUACAAUAGCUU | 3001 |
| R-008396760-000L | 1334 | 585 | GCUAUUGUAGAAGCUGGUG | B GCUAUUGUAGAAGCUGGUGTT B | 3000 |
| R-008396763-000M | 971 | 586 | GGAGGCAUUCCUGCCCUGG | B GGAGGCAUUCCUGCCCUGGTT B | 3002 |
| R-008396763-000M | 971 | 586 | GGAGGCAUUCCUGCCCUGG | CCAGGGCAGGAAUGCCUCCUU | 3003 |
| R-008396766-000N | 2493 | 587 | ACCACCCUGGUGCUGACUA | UAGUCAGCACCAGGGUGGUUU | 3005 |
| R-008396766-000N | 2493 | 587 | ACCACCCUGGUGCUGACUA | B ACCACCCUGGUGCUGACUATT B | 3004 |
| R-008396769-000P | 1814 | 588 | AAUCUUGCCCUUUGUCCCG | B AAUCUUGCCCUUUGUCCCGTT B | 3006 |
| R-008396769-000P | 1814 | 588 | AAUCUUGCCCUUUGUCCCG | CGGGACAAAGGGCAAGAUUUU | 3007 |
| R-008396772-000W | 1088 | 589 | CGUUUAGCUGGUGGGCUGC | GCAGCCCACCAGCUAAACGUU | 3009 |
| R-008396772-000W | 1088 | 589 | CGUUUAGCUGGUGGGCUGC | B CGUUUAGCUGGUGGGCUGCTT B | 3008 |
| R-008396775-000X | 2292 | 590 | CAGUUGAGCUGACCAGCUC | GAGCUGGUCAGCUCAACUGUU | 3011 |
| R-008396775-000X | 2292 | 590 | CAGUUGAGCUGACCAGCUC | B CAGUUGAGCUGACCAGCUCTT B | 3010 |
| R-008396778-000Y | 1504 | 591 | UGAUAUAAAUGUGGUCACC | GGUGACCACAUUUAUAUCAUU | 3013 |
| R-008396778-000Y | 1504 | 591 | UGAUAUAAAUGUGGUCACC | B UGAUAUAAAUGUGGUCACCTT B | 3012 |
| R-008396781-000E | 404 | 592 | CUGAGUGGUAAAGGCAAUC | GAUUGCCUUUACCACUCAGUU | 3015 |
| R-008396781-000E | 404 | 592 | CUGAGUGGUAAAGGCAAUC | B CUGAGUGGUAAAGGCAAUCTT B | 3014 |
| R-008396784-000F | 1301 | 593 | AAGGUGCUAUCUGUCUGCU | AGCAGACAGAUAGCACCUUUU | 3017 |
| R-008396784-000F | 1301 | 593 | AAGGUGCUAUCUGUCUGCU | B AAGGUGCUAUCUGUCUGCUTT B | 3016 |
| R-008396787-000G | 2004 | 594 | UCCUAGCUCGGGAUGUUCA | UGAACAUCCCGAGCUAGGAUU | 3019 |
| R-008396787-000G | 2004 | 594 | UCCUAGCUCGGGAUGUUCA | B UCCUAGCUCGGGAUGUUCATT B | 3018 |
| R-008396790-000N | 853 | 6 | GUCUGCUAUUGUACGUACC | GGUACGUACAAUAGCAGACUU | 3021 |
| R-008396790-000N | 853 | 6 | GUCUGCUAUUGUACGUACC | B GUCUGCUAUUGUACGUACCTT B | 3020 |
| R-008396793-000P | 277 | 595 | UCAAGCUGAUUUGAUGGAG | B UCAAGCUGAUUUGAUGGAGTT B | 3022 |
| R-008396793-000P | 277 | 595 | UCAAGCUGAUUUGAUGGAG | CUCCAUCAAAUCAGCUUGAUU | 3023 |
| R-008396796-000R | 2304 | 596 | CCAGCUCUCUCUUCAGAAC | GUUCUGAAGAGAGAGCUGGUU | 3025 |
| R-008396796-000R | 2304 | 596 | CCAGCUCUCUCUUCAGAAC | B CCAGCUCUCUCUUCAGAACTT B | 3024 |
| R-008396799-000S | 300 | 597 | ACAUGGCCAUGGAACCAGA | B ACAUGGCCAUGGAACCAGATT B | 3026 |
| R-008396799-000S | 300 | 597 | ACAUGGCCAUGGAACCAGA | UCUGGUUCCAUGGCCAUGUUU | 3027 |
| R-008396802-000J | 1906 | 598 | UACCCAGCGCCGUACGUCC | B UACCCAGCGCCGUACGUCCTT B | 3028 |
| R-008396802-000J | 1906 | 598 | UACCCAGCGCCGUACGUCC | GGACGUACGGCGCUGGGUAUU | 3029 |
| R-008396805-000K | 1973 | 599 | AUAGUUGAAGGUUGUACCG | CGGUACAACCUUCAACUAUUU | 3031 |
| R-008396805-000K | 1973 | 599 | AUAGUUGAAGGUUGUACCG | B AUAGUUGAAGGUUGUACCGTT B | 3030 |
| R-008396808-000L | 1360 | 600 | AGCUUUAGGACUUCACCUG | B AGCUUUAGGACUUCACCUGTT B | 3032 |
| R-008396808-000L | 1360 | 600 | AGCUUUAGGACUUCACCUG | CAGGUGAAGUCCUAAAGCUUU | 3033 |
| R-008396811-000T | 2094 | 601 | ACAUCCAAAGAGUAGCGCU | GCAGCUACUCUUUGGAUGUUU | 3035 |
| R-008396811-000T | 2094 | 601 | ACAUCCAAAGAGUAGCGCU | B ACAUCCAAAGAGUAGCUGCTT B | 3034 |
| R-008396814-000U | 920 | 602 | UUGCAUAACCUUUCCCAUC | B UUGCAUAACCUUUCCCAUCTT B | 3036 |
| R-008396814-000U | 920 | 602 | UUGCAUAACCUUUCCCAUC | GAUGGGAAAGGUUAUGCAAUU | 3037 |
| R-008396817-000V | 1707 | 603 | UGGCCCAGAAUGCAGUUCG | CGAACUGCAUUCUGGGCCAUU | 3039 |
| R-008396817-000V | 1707 | 603 | UGGCCCAGAAUGCAGUUCG | B UGGCCCAGAAUGCAGUUCGTT B | 3038 |
| R-008396820-000B | 1808 | 604 | AUUCGAAAUCUUGCCCUUU | B AUUCGAAAUCUUGCCCUUUTT B | 3040 |
| R-008396820-000B | 1808 | 604 | AUUCGAAAUCUUGCCCUUU | AAAGGGCAAGAUUUCGAAUUU | 3041 |
| R-008396823-000C | 1326 | 605 | AUAAGCGGCUAUUGUAGA | UCUACAAUAGCCGCUUAUUU | 3043 |
| R-008396823-000C | 1326 | 605 | AUAAGCGGCUAUUGUAGA | B AUAAGCCGGCUAUUGUAGATT B | 3042 |
| R-008396826-000D | 1158 | 606 | CGACAGACUGCCUUCAAAU | B CGACAGACUGCCUUCAAAUTT B | 3044 |
| R-008396826-000D | 1158 | 606 | CGACAGACUGCCUUCAAAU | AUUUGAAGGCAGUCUGUCGUU | 3045 |
| R-008396829-000E | 781 | 607 | UGCAGUUAUGGUCCAUCAG | B UGCAGUUAUGGUCCAUCAGTT B | 3046 |
| R-008396829-000E | 781 | 607 | UGCAGUUAUGGUCCAUCAG | CUGAUGGACCAUAACUGCAUU | 3047 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396832-000L | 607 | 608 | GUUUGAUGCUGCUCAUCCC | B GUUUGAUGCUGCUCAUCCCTT B | 3048 |
| R-008396832-000L | 607 | 608 | GUUUGAUGCUGCUCAUCCC | GGGAUGAGCAGCAUCAAACUU | 3049 |
| R-008396835-000M | 627 | 609 | CUAAUGUCCAGCGUUUGGC | GCCAAACGCUGGACAUUAGUU | 3051 |
| R-008396835-000M | 627 | 609 | CUAAUGUCCAGCGUUUGGC | B CUAAUGUCCAGCGUUUGGCTT B | 3050 |
| R-008396838-000N | 500 | 610 | CAAGUAGCUGAUAUUGAUG | B CAAGUAGCUGAUAUUGAUGTT B | 3052 |
| R-008396838-000N | 500 | 610 | CAAGUAGCUGAUAUUGAUG | CAUCAAUAUCAGCUACUUGUU | 3053 |
| R-008396841-000V | 2185 | 611 | UCUGACAGAGUUACUUCAC | B UCUGACAGAGUUACUUCACTT B | 3054 |
| R-008396841-000V | 2185 | 611 | UCUGACAGAGUUACUUCAC | GUGAAGUAACUCUGUCAGAUU | 3055 |
| R-008396844-000W | 1592 | 612 | GGUGGUAUAGAGGCUCUUG | B GGUGGUAUAGAGGCUCUUGTT B | 3056 |
| R-008396844-000W | 1592 | 612 | GGUGGUAUAGAGGCUCUUG | CAAGAGCCUCUAUACCACCUU | 3057 |
| R-008396847-000X | 758 | 613 | GACCAGGUGGUGGUUAAUA | B GACCAGGUGGUGGUUAAUATT B | 3058 |
| R-008396847-000X | 758 | 613 | GACCAGGUGGUGGUUAAUA | UAUUAACCACCACCUGGUCUU | 3059 |
| R-008396850-000D | 2551 | 614 | CCUCAUGGAUGGGCUGCCU | B CCUCAUGGAUGGGCUGCCUTT B | 3060 |
| R-008396850-000D | 2551 | 614 | CCUCAUGGAUGGGCUGCCU | AGGCAGCCCAUCCAUGAGGUU | 3061 |
| R-008396853-000E | 1409 | 615 | UGUCUUUGGACUCUCAGGA | B UGUCUUUGGACUCUCAGGATT B | 3062 |
| R-008396853-000E | 1409 | 615 | UGUCUUUGGACUCUCAGGA | UCCUGAGAGUCCAAAGACAUU | 3063 |
| R-008396856-000F | 497 | 616 | GAACAAGUAGCUGAUAUUG | B GAACAAGUAGCUGAUAUUGTT B | 3064 |
| R-008396856-000F | 497 | 616 | GAACAAGUAGCUGAUAUUG | CAAUAUCAGCUACUUGUUCUU | 3065 |
| R-008396859-000G | 381 | 617 | GUGCCACUACCACAGCUCC | B GUGCCACUACCACAGCUCCTT B | 3066 |
| R-008396859-000G | 381 | 617 | GUGCCACUACCACAGCUCC | GGAGCUGUGGUAGUGGCACUU | 3067 |
| R-008396862-000N | 1841 | 618 | GCACCUUUGCGUGAGCAGG | CCUGCUCACGCAAAGGUGCUU | 3069 |
| R-008396862-000N | 1841 | 618 | GCACCUUUGCGUGAGCAGG | B GCACCUUUGCGUGAGCAGGTT B | 3068 |
| R-008396865-000P | 1368 | 619 | GACUUCACCUGACAGAUCC | B GACUUCACCUGACAGAUCCTT B | 3070 |
| R-008396865-000P | 1368 | 619 | GACUUCACCUGACAGAUCC | GGAUCUGUCAGGUGAAGUCUU | 3071 |
| R-008396868-000R | 2047 | 620 | AAAUACCAUUCCAUUGUUU | AAACAAUGGAAUGGUAUUUUU | 3073 |
| R-008396868-000R | 2047 | 620 | AAAUACCAUUCCAUUGUUU | B AAAUACCAUUCCAUUGUUUTT B | 3072 |
| R-008396871-000X | 492 | 621 | CUCAAGAACAAGUAGCUGA | B CUCAAGAACAAGUAGCUGATT B | 3074 |
| R-008396871-000X | 492 | 621 | CUCAAGAACAAGUAGCUGA | UCAGCUACUUGUUCUUGAGUU | 3075 |
| R-008396874-000Y | 832 | 126 | CAUGCGUUCUCCUCAGAUG | B CAUGCGUUCUCCUCAGAUGTT B | 3076 |
| R-008396874-000Y | 832 | 126 | CAUGCGUUCUCCUCAGAUG | CAUCUGAGGAGAACGCAUGUU | 3077 |
| R-008396877-000Z | 2118 | 622 | UCCUCUGUGAACUUGCUCA | B UCCUCUGUGAACUUGCUCATT B | 3078 |
| R-008396877-000Z | 2118 | 622 | UCCUCUGUGAACUUGCUCA | UGAGCAAGUUCACAGAGGAUU | 3079 |
| R-008396880-000F | 968 | 623 | UCUGGAGGCAUUCCUGCCC | GGGCAGGAAUGCCUCCAGAUU | 3081 |
| R-008396880-000F | 968 | 623 | UCUGGAGGCAUUCCUGCCC | B UCUGGAGGCAUUCCUGCCCTT B | 3080 |
| R-008396883-000G | 965 | 624 | AAGUCUGGAGGCAUUCCUG | CAGGAAUGCCUCCAGACUUUU | 3083 |
| R-008396883-000G | 965 | 624 | AAGUCUGGAGGCAUUCCUG | B AAGUCUGGAGGCAUUCCUGTT B | 3082 |
| R-008396886-000H | 1977 | 625 | UUGAAGGUUGUACCGGAGC | GCUCCGGUACAACCUUCAAUU | 3085 |
| R-008396886-000H | 1977 | 625 | UUGAAGGUUGUACCGGAGC | B UUGAAGGUUGUACCGGAGCTT B | 3084 |
| R-008396889-000J | 2001 | 626 | ACAUCCUAGCUCGGGAUGU | B ACAUCCUAGCUCGGGAUGUTT B | 3086 |
| R-008396889-000J | 2001 | 626 | ACAUCCUAGCUCGGGAUGU | ACAUCCCGAGCUAGGAUGUUU | 3087 |
| R-008396892-000R | 1191 | 627 | ACCAAGAAAGCAAGCUCAU | B ACCAAGAAAGCAAGCUCAUTT B | 3088 |
| R-008396892-000R | 1191 | 627 | ACCAAGAAAGCAAGCUCAU | AUGAGCUUGCUUUCUUGGUUU | 3089 |
| R-008396895-000S | 640 | 628 | UUUGGCUGAACCAUCACAG | B UUUGGCUGAACCAUCACAGTT B | 3090 |
| R-008396895-000S | 640 | 628 | UUUGGCUGAACCAUCACAG | CUGUGAUGGUUCAGCCAAAUU | 3091 |
| R-008396898-000T | 715 | 629 | CACACGUGCAAUCCCUGAA | B CACACGUGCAAUCCCUGAATT B | 3092 |
| R-008396898-000T | 715 | 629 | CACACGUGCAAUCCCUGAA | UUCAGGGAUUGCACGUGUGUU | 3093 |
| R-008396901-000K | 1204 | 630 | GCUCAUCAUACUGGCUAGU | ACUAGCCAGUAUGAUGAGCUU | 3095 |
| R-008396901-000K | 1204 | 630 | GCUCAUCAUACUGGCUAGU | B GCUCAUCAUACUGGCUAGUTT B | 3094 |
| R-008396904-000L | 3093 | 631 | GGGUAGGGUAAAUCAGUAA | B GGGUAGGGUAAAUCAGUAATT B | 3096 |
| R-008396904-000L | 3093 | 631 | GGGUAGGGUAAAUCAGUAA | UUACUGAUUUACCCUACCCUU | 3097 |
| R-008396907-000M | 1371 | 632 | UUCACCUGACAGAUCCAAG | CUUGGAUCUGUCAGGUGAAUU | 3099 |
| R-008396907-000M | 1371 | 632 | UUCACCUGACAGAUCCAAG | B UUCACCUGACAGAUCCAAGTT B | 3098 |
| R-008396910-000U | 1424 | 121 | AGGAAUCUUUCAGAUGCUG | B AGGAAUCUUUCAGAUGCUGTT B | 3100 |
| R-008396910-000U | 1424 | 121 | AGGAAUCUUUCAGAUGCUG | CAGCAUCUGAAAGAUUCCUUU | 3101 |
| R-008396913-000V | 860 | 161 | AUUGUACGUACCAUGCAGA | B AUUGUACGUACCAUGCAGATT B | 3102 |
| R-008396913-000V | 860 | 161 | AUUGUACGUACCAUGCAGA | UCUGCAUGGUACGUACAAUUU | 3103 |
| R-008396916-000W | 409 | 633 | UGGUAAAGGCAAUCCUGAG | B UGGUAAAGGCAAUCCUGAGTT B | 3104 |
| R-008396916-000W | 409 | 633 | UGGUAAAGGCAAUCCUGAG | CUCAGGAUUGCCUUUACCAUU | 3105 |
| R-008396919-000X | 1143 | 7 | AAUUCUUGGCUAUUACGAC | GUCGUAAUAGCCAAGAAUUUU | 3107 |
| R-008396919-000X | 1143 | 7 | AAUUCUUGGCUAUUACGAC | B AAUUCUUGGCUAUUACGACTT B | 3106 |
| R-008396922-000D | 2405 | 634 | GAUCCUAGCUAUCGUUCUU | B GAUCCUAGCUAUCGUUCUUTT B | 3108 |
| R-008396922-000D | 2405 | 634 | GAUCCUAGCUAUCGUUCUU | AAGAACGAUAGCUAGGAUCUU | 3109 |
| R-008396928-000F | 1671 | 635 | UUCGUCAUCUGACCAGCCG | CGGCUGGUCAGAUGACGAAUU | 3111 |
| R-008396928-000F | 1671 | 635 | UUCGUCAUCUGACCAGCCG | B UUCGUCAUCUGACCAGCCGTT B | 3110 |
| R-008396931-000M | 1427 | 636 | AAUCUUUCAGAUGCUGCAA | B AAUCUUUCAGAUGCUGCAATT B | 3112 |
| R-008396931-000M | 1427 | 636 | AAUCUUUCAGAUGCUGCAA | UUGCAGCAUCUGAAAGAUUUU | 3113 |
| R-008396934-000N | 1717 | 637 | UGCAGUUCGCCUUCACUAU | AUAGUGAAGGCGAACUGCAUU | 3115 |
| R-008396934-000N | 1717 | 637 | UGCAGUUCGCCUUCACUAU | B UGCAGUUCGCCUUCACUAUTT B | 3114 |
| R-008396937-000P | 2400 | 638 | AGGAUGAUCCUAGCUAUCG | CGAUAGCUAGGAUCAUCCUUU | 3117 |
| R-008396937-000P | 2400 | 638 | AGGAUGAUCCUAGCUAUCG | B AGGAUGAUCCUAGCUAUCGTT B | 3116 |
| R-008396940-000W | 2305 | 639 | CAGCUCUCUCUUCAGAACA | B CAGCUCUCUCUUCAGAACATT B | 3118 |
| R-008396940-000W | 2305 | 639 | CAGCUCUCUCUUCAGAACA | UGUUCUGAAGAGAGCUGUU | 3119 |
| R-008396943-000X | 1928 | 640 | GGUGGGACACAGCAGCAAU | B GGUGGGACACAGCAGCAAUTT B | 3120 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008396943-000X | 1928 | 640 | GGUGGGACACAGCAGCAAU | AUUGCUGCUGUGUCCCACCUU | 3121 |
| R-008396946-000Y | 2399 | 641 | CAGGAUGAUCCUAGCUAUC | B CAGGAUGAUCCUAGCUAUCTT B | 3122 |
| R-008396946-000Y | 2399 | 641 | CAGGAUGAUCCUAGCUAUC | GAUAGCUAGGAUCAUCCUGUU | 3123 |
| R-008396949-000Z | 426 | 642 | AGGAAGAGGAUGUGGAUAC | B AGGAAGAGGAUGUGGAUACTT B | 3124 |
| R-008396949-000Z | 426 | 642 | AGGAAGAGGAUGUGGAUAC | GUAUCCACAUCCUCUUCCUUU | 3125 |
| R-008396952-000F | 1309 | 643 | AUCUGUCUGCUCUAGUAAU | AUUACUAGAGCAGACAGAUUU | 3127 |
| R-008396952-000F | 1309 | 643 | AUCUGUCUGCUCUAGUAAU | B AUCUGUCUGCUCUAGUAAUTT B | 3126 |
| R-008396955-000G | 925 | 644 | UAACCUUUCCCAUCAUCGU | B UAACCUUUCCCAUCAUCGUTT B | 3128 |
| R-008396955-000G | 925 | 644 | UAACCUUUCCCAUCAUCGU | ACGAUGAUGGGAAAGGUUAUU | 3129 |
| R-008396958-000H | 2072 | 645 | CUGCUUUAUUCUCCCAUUG | CAAUGGGAGAAUAAAGCAGUU | 3131 |
| R-008396958-000H | 2072 | 645 | CUGCUUUAUUCUCCCAUUG | B CUGCUUUAUUCUCCCAUUGTT B | 3130 |
| R-008396964-000R | 2939 | 646 | AAUUGUAAUCUGAAUAAAG | B AAUUGUAAUCUGAAUAAAGTT B | 3132 |
| R-008396964-000R | 2939 | 646 | AAUUGUAAUCUGAAUAAAG | CUUUAUUCAGAUUACAAUUUU | 3133 |
| R-008396973-000Z | 1480 | 647 | UCUUGUUCAGCUUCUGGGU | B UCUUGUUCAGCUUCUGGGUTT B | 3134 |
| R-008396973-000Z | 1480 | 647 | UCUUGUUCAGCUUCUGGGU | ACCCAGAAGCUGAACAAGAUU | 3135 |
| R-008396976-000A | 1889 | 648 | GUUCGUGCACAUCAGGAUA | B GUUCGUGCACAUCAGGAUATT B | 3136 |
| R-008396976-000A | 1889 | 648 | GUUCGUGCACAUCAGGAUA | UAUCCUGAUGUGCACGAACUU | 3137 |
| R-008396979-000B | 699 | 649 | AUGAUGCAGAACUUGCCAC | B AUGAUGCAGAACUUGCCACTT B | 3138 |
| R-008396979-000B | 699 | 649 | AUGAUGCAGAACUUGCCAC | GUGGCAAGUUCUGCAUCAUUU | 3139 |
| R-008396982-000H | 506 | 650 | GCUGAUAUUGAUGGACAGU | B GCUGAUAUUGAUGGACAGUTT B | 3140 |
| R-008396982-000H | 506 | 650 | GCUGAUAUUGAUGGACAGU | ACUGUCCAUCAAUAUCAGCUU | 3141 |
| R-008396985-000J | 1750 | 651 | GGUUAAGCUCUUACACCCA | UGGGUGUAAGAGCUUAACCUU | 3143 |
| R-008396985-000J | 1750 | 651 | GGUUAAGCUCUUACACCCA | B GGUUAAGCUCUUACACCCATT B | 3142 |
| R-008396988-000K | 1820 | 652 | GCCCUUUGUCCCGCAAAUC | B GCCCUUUGUCCCGCAAAUCTT B | 3144 |
| R-008396988-000K | 1820 | 652 | GCCCUUUGUCCCGCAAAUC | GAUUUGCGGGACAAAGGGCUU | 3145 |
| R-008396991-000S | 541 | 653 | UCAGAGGGUACGAGCUGCU | AGCAGCUCGUACCCUCUGAUU | 3147 |
| R-008396991-000S | 541 | 653 | UCAGAGGGUACGAGCUGCU | B UCAGAGGGUACGAGCUGCUTT B | 3146 |
| R-008396994-000T | 880 | 102 | UACAAAUGAUGUAGAAACA | B UACAAAUGAUGUAGAAACATT B | 3148 |
| R-008396994-000T | 880 | 102 | UACAAAUGAUGUAGAAACA | UGUUUCUACAUCAUUUGUAUU | 3149 |
| R-008396997-000U | 665 | 654 | AAACAUGCAGUUGUAAACU | B AAACAUGCAGUUGUAAACUTT B | 3150 |
| R-008396997-000U | 665 | 654 | AAACAUGCAGUUGUAAACU | AGUUUACAACUGCAUGUUUUU | 3151 |
| R-008397000-000H | 1817 | 655 | CUUGCCCUUUGUCCCGCAA | UUGCGGGACAAAGGGCAAGUU | 3153 |
| R-008397000-000H | 1817 | 655 | CUUGCCCUUUGUCCCGCAA | B CUUGCCCUUUGUCCCGCAATT B | 3152 |
| R-008397003-000J | 2275 | 656 | UUACAAGAAACGGCUUUCA | UGAAAGCCGUUUCUUGUAAUU | 3155 |
| R-008397003-000J | 2275 | 656 | UUACAAGAAACGGCUUUCA | B UUACAAGAAACGGCUUUCATT B | 3154 |
| R-008397006-000K | 2426 | 657 | CACUCUGGUGGAUAUGGCC | GGCCAUAUCCACCAGAGUGUU | 3157 |
| R-008397006-000K | 2426 | 657 | CACUCUGGUGGAUAUGGCC | B CACUCUGGUGGAUAUGGCCTT B | 3156 |
| R-008397009-000L | 958 | 658 | CAUCUUUAAGUCUGGAGGC | B CAUCUUUAAGUCUGGAGGCTT B | 3158 |
| R-008397009-000L | 958 | 658 | CAUCUUUAAGUCUGGAGGC | GCCUCCAGACUUAAAGAUGUU | 3159 |
| R-008397012-000T | 1657 | 659 | UGCCAUCUGUGCUCUUCGU | B UGCCAUCUGUGCUCUUCGUTT B | 3160 |
| R-008397012-000T | 1657 | 659 | UGCCAUCUGUGCUCUUCGU | ACGAAGAGCACAGAUGGCAUU | 3161 |
| R-008397015-000U | 1146 | 660 | UCUUGGCUAUUACGACAGA | UCUGUCGUAAUAGCCAAGAUU | 3163 |
| R-008397015-000U | 1146 | 660 | UCUUGGCUAUUACGACAGA | B UCUUGGCUAUUACGACAGATT B | 3162 |
| R-008397018-000V | 3078 | 661 | AUUUGGGAUAUGUAUGGGU | B AUUUGGGAUAUGUAUGGGUTT B | 3164 |
| R-008397018-000V | 3078 | 661 | AUUUGGGAUAUGUAUGGGU | ACCCAUACAUAUCCCAAAUUU | 3165 |
| R-008397021-000B | 1008 | 662 | CAGUGGAUUCUGUGUUGUU | AACAACACAGAAUCCACUGUU | 3167 |
| R-008397021-000B | 1008 | 662 | CAGUGGAUUCUGUGUUGUU | B CAGUGGAUUCUGUGUUGUUTT B | 3166 |
| R-008397024-000C | 1621 | 663 | CCUUCGGGCUGGUGACAGG | CCUGUCACCAGCCCGAAGGUU | 3169 |
| R-008397024-000C | 1621 | 663 | CCUUCGGGCUGGUGACAGG | B CCUUCGGGCUGGUGACAGGTT B | 3168 |
| R-008397027-000D | 1932 | 664 | GGACACAGCAGCAAUUUGU | B GGACACAGCAGCAAUUUGUTT B | 3170 |
| R-008397027-000D | 1932 | 664 | GGACACAGCAGCAAUUUGU | ACAAAUUGCUGCUGUGUCCUU | 3171 |
| R-008397030-000K | 1909 | 665 | CCAGCGCCGUACGUCCAUG | CAUGGACGUACGGCGCUGGUU | 3173 |
| R-008397030-000K | 1909 | 665 | CCAGCGCCGUACGUCCAUG | B CCAGCGCCGUACGUCCAUGTT B | 3172 |
| R-008397033-000L | 2279 | 666 | AAGAAACGGCUUUCAGUUG | CAACUGAAAGCCGUUUCUUUU | 3175 |
| R-008397033-000L | 2279 | 666 | AAGAAACGGCUUUCAGUUG | B AAGAAACGGCUUUCAGUUGTT B | 3174 |
| R-008397036-000M | 574 | 667 | AUUAGAUGAGGGCAUGCAG | B AUUAGAUGAGGGCAUGCAGTT B | 3176 |
| R-008397036-000M | 574 | 667 | AUUAGAUGAGGGCAUGCAG | CUGCAUGCCCUCAUCUAAUUU | 3177 |
| R-008397039-000N | 2303 | 668 | ACCAGCUCUCUCUUCAGAA | UUCUGAAGAGAGAGCUGGUUU | 3179 |
| R-008397039-000N | 2303 | 668 | ACCAGCUCUCUCUUCAGAA | B ACCAGCUCUCUCUUCAGAATT B | 3178 |
| R-008397042-000V | 784 | 669 | AGUUAUGGUCCAUCAGCUU | B AGUUAUGGUCCAUCAGCUUTT B | 3180 |
| R-008397042-000V | 784 | 669 | AGUUAUGGUCCAUCAGCUU | AAGCUGAUGGACCAUAACUUU | 3181 |
| R-008397045-000W | 2507 | 670 | GACUAUCCAGUUGAUGGGC | GCCCAUCAACUGGAUAGUCUU | 3183 |
| R-008397045-000W | 2507 | 670 | GACUAUCCAGUUGAUGGGC | B GACUAUCCAGUUGAUGGGCTT B | 3182 |
| R-008397048-000X | 995 | 671 | AUGCUUGGUUCACCAGUGG | B AUGCUUGGUUCACCAGUGGTT B | 3184 |
| R-008397048-000X | 995 | 671 | AUGCUUGGUUCACCAGUGG | CCACUGGUGAACCAAGCAUUU | 3185 |
| R-008397051-000D | 2006 | 672 | CUAGCUCGGGAUGUUCACA | UGUGAACAUCCCGAGCUAGUU | 3187 |
| R-008397051-000D | 2006 | 672 | CUAGCUCGGGAUGUUCACA | B CUAGCUCGGGAUGUUCACATT B | 3186 |
| R-008397054-000E | 1757 | 673 | CUCUUACACCCACCAUCCC | GGGAUGGUGGGUGUAAGAGUU | 3189 |
| R-008397054-000E | 1757 | 673 | CUCUUACACCCACCAUCCC | B CUCUUACACCCACCAUCCCTT B | 3188 |
| R-008397057-000F | 2129 | 674 | CUUGCUCAGGACAAGGAAG | B CUUGCUCAGGACAAGGAAGTT B | 3190 |
| R-008397057-000F | 2129 | 674 | CUUGCUCAGGACAAGGAAG | CUUCCUUGUCCUGAGCAAGUU | 3191 |
| R-008397060-000M | 2272 | 675 | AGAUUACAAGAAACGGCUU | B AGAUUACAAGAAACGGCUUTT B | 3192 |
| R-008397060-000M | 2272 | 675 | AGAUUACAAGAAACGGCUU | AAGCCGUUUCUUGUAAUCUUU | 3193 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397063-000N | 389 | 676 | ACCACAGCUCCUUCUCUGA | B ACCACAGCUCCUUCUCUGATT B | 3194 |
| R-008397063-000N | 389 | 676 | ACCACAGCUCCUUCUCUGA | UCAGAGAAGGAGCUGUGGUUU | 3195 |
| R-008397066-000P | 708 | 176 | AACUUGCCACACGUGCAAU | B AACUUGCCACACGUGCAAUTT B | 3196 |
| R-008397066-000P | 708 | 176 | AACUUGCCACACGUGCAAU | AUUGCACGUGUGGCAAGUUU | 3197 |
| R-008397069-000R | 1435 | 677 | AGAUGCUGCAACUAAACAG | CUGUUUAGUUGCAGCAUCUUU | 3199 |
| R-008397069-000R | 1435 | 677 | AGAUGCUGCAACUAAACAG | B AGAUGCUGCAACUAAACAGTT B | 3198 |
| R-008397072-000X | 1247 | 34 | AUAAUGAGGACCUAUACUU | B AUAAUGAGGACCUAUACUUT B | 3200 |
| R-008397072-000X | 1247 | 34 | AUAAUGAGGACCUAUACUU | AAGUAUAGGUCCUCAUUAUUU | 3201 |
| R-008397075-000Y | 1752 | 678 | UUAAGCUCUUACACCCACC | GGUGGGUGUAAGAGCUUAAUU | 3203 |
| R-008397075-000Y | 1752 | 678 | UUAAGCUCUUACACCCACC | B UUAAGCUCUUACACCCACCTT B | 3202 |
| R-008397078-000Z | 773 | 679 | AAUAAGGCUGCAGUUAUGG | CCAUAACUGCAGCCUUAUUUU | 3205 |
| R-008397078-000Z | 773 | 679 | AAUAAGGCUGCAGUUAUGG | B AAUAAGGCUGCAGUUAUGGTT B | 3204 |
| R-008397081-000F | 3080 | 680 | UUGGGAUAUGUAUGGGUAG | CUACCCAUACAUAUCCCAAUU | 3207 |
| R-008397081-000F | 3080 | 680 | UUGGGAUAUGUAUGGGUAG | B UUGGGAUAUGUAUGGGUAGTT B | 3206 |
| R-008397084-000G | 3174 | 681 | GUACCUGCUGUGAUACGA | B GUACCUGCUGUGAUACGATT B | 3208 |
| R-008397084-000G | 3174 | 681 | GUACCUGCUGUGAUACGA | UCGUAUCACAGCAGGUUACUU | 3209 |
| R-008397087-000H | 1578 | 682 | UGGUCUGCCAAGUGGGUGG | B UGGUCUGCCAAGUGGGUGGTT B | 3210 |
| R-008397087-000H | 1578 | 682 | UGGUCUGCCAAGUGGGUGG | C CACCCACUUGGCAGACCAUU | 3211 |
| R-008397090-000P | 398 | 683 | CCUUCUCUGAGUGGUAAAG | B CCUUCUCUGAGUGGUAAAGTT B | 3212 |
| R-008397090-000P | 398 | 683 | CCUUCUCUGAGUGGUAAAG | CUUUACCACUCAGAGAAGGUU | 3213 |
| R-008397093-000R | 2153 | 684 | GAAGCUAUUGAAGCUGAGG | CCUCAGCUUCAAUAGCUUCUU | 3215 |
| R-008397093-000R | 2153 | 684 | GAAGCUAUUGAAGCUGAGG | B GAAGCUAUUGAAGCUGAGGTT B | 3214 |
| R-008397096-000S | 702 | 685 | AUGCAGAACUUGCCACACG | CGUGUGGCAAGUUCUGCAUUU | 3217 |
| R-008397096-000S | 702 | 685 | AUGCAGAACUUGCCACACG | B AUGCAGAACUUGCCACACGTT B | 3216 |
| R-008397099-000T | 503 | 686 | GUAGCUGAUAUUGAUGGAC | B GUAGCUGAUAUUGAUGGACTT B | 3218 |
| R-008397099-000T | 503 | 686 | GUAGCUGAUAUUGAUGGAC | GUCCAUCAAUAUCAGCUACUU | 3219 |
| R-008397102-000K | 276 | 687 | CUCAAGCUGAUUUGAUGGA | B CUCAAGCUGAUUUGAUGGATT B | 3220 |
| R-008397102-000K | 276 | 687 | CUCAAGCUGAUUUGAUGGA | UCCAUCAAAUCAGCUUGAGUU | 3221 |
| R-008397105-000L | 1962 | 688 | GCAUGGAAGAAAUAGUUGA | B GCAUGGAAGAAAUAGUUGATT B | 3222 |
| R-008397105-000L | 1962 | 688 | GCAUGGAAGAAAUAGUUGA | UCAACUAUUUCUUCCAUGCUU | 3223 |
| R-008397108-000M | 1347 | 689 | CUGGUGGAAUGCAAGCUUU | B CUGGUGGAAUGCAAGCUUUTT B | 3224 |
| R-008397108-000M | 1347 | 689 | CUGGUGGAAUGCAAGCUUU | AAAGCUUGCAUUCCACCAGUU | 3225 |
| R-008397111-000U | 2544 | 690 | CCCAGGACCUCAUGGAUGG | CCAUCCAUGAGGUCCUGGGUU | 3227 |
| R-008397111-000U | 2544 | 690 | CCCAGGACCUCAUGGAUGG | B CCCAGGACCUCAUGGAUGGTT B | 3226 |
| R-008397114-000V | 3079 | 691 | UUUGGGAUAUGUAUGGGUA | B UUUGGGAUAUGUAUGGGUATT B | 3228 |
| R-008397114-000V | 3079 | 691 | UUUGGGAUAUGUAUGGGUA | UACCCAUACAUAUCCCAAAUU | 3229 |
| R-008397117-000W | 3164 | 692 | CAAAGUUGUUGUAACCUGC | GCAGGUUACAACAACUUUGUU | 3231 |
| R-008397117-000W | 3164 | 692 | CAAAGUUGUUGUAACCUGC | B CAAAGUUGUUGUAACCUGCTT B | 3230 |
| R-008397120-000C | 2026 | 693 | CCGAAUUGUUAUCAGAGGA | B CCGAAUUGUUAUCAGAGGATT B | 3232 |
| R-008397120-000C | 2026 | 693 | CCGAAUUGUUAUCAGAGGA | UCCUCUGAUAACAAUUCGGUU | 3233 |
| R-008397123-000D | 2938 | 694 | UAAUUGUAAUCUGAAUAAA | B UAAUUGUAAUCUGAAUAAATT B | 3234 |
| R-008397123-000D | 2938 | 694 | UAAUUGUAAUCUGAAUAAA | UUUAUUCAGAUUACAAUUAUU | 3235 |
| R-008397126-000E | 2940 | 695 | AUUGUAAUCUGAAUAAAGU | ACUUUAUUCAGAUUACAAUUU | 3237 |
| R-008397126-000E | 2940 | 695 | AUUGUAAUCUGAAUAAAGU | B AUUGUAAUCUGAAUAAAGUTT B | 3236 |
| R-008397129-000F | 2027 | 696 | CGAAUUGUUAUCAGAGGAC | B CGAAUUGUUAUCAGAGGACTT B | 3238 |
| R-008397129-000F | 2027 | 696 | CGAAUUGUUAUCAGAGGAC | GUCCUCUGAUAACAAUUCGUU | 3239 |
| R-008397132-000M | 448 | 697 | CCAAGUCCUGUAUGAGUGG | CCACUCAUACAGGACUUGGUU | 3241 |
| R-008397132-000M | 448 | 697 | CCAAGUCCUGUAUGAGUGG | B CCAAGUCCUGUAUGAGUGGTT B | 3240 |
| R-008397135-000N | 1328 | 698 | AAGCCGGCUAUUGUAGAAG | B AAGCCGGCUAUUGUAGAAGTT B | 3242 |
| R-008397135-000N | 1328 | 698 | AAGCCGGCUAUUGUAGAAG | CUUCUACAAUAGCCGGCUUUU | 3243 |
| R-008397138-000P | 1970 | 33 | GAAAUAGUUGAAGGUUGUA | UACAACCUUCAACUAUUUCUU | 3245 |
| R-008397138-000P | 1970 | 33 | GAAAUAGUUGAAGGUUGUA | B GAAAUAGUUGAAGGUUGUATT B | 3244 |
| R-008397141-000W | 2406 | 699 | AUCCUAGCUAUCGUUCUUU | AAAGAACGAUAGCUAGGAUUU | 3247 |
| R-008397141-000W | 2406 | 699 | AUCCUAGCUAUCGUUCUUU | B AUCCUAGCUAUCGUUCUUUTT B | 3246 |
| R-008397144-000X | 924 | 700 | AUAACCUUUCCCAUCAUCG | B AUAACCUUUCCCAUCAUCGTT B | 3248 |
| R-008397144-000X | 924 | 700 | AUAACCUUUCCCAUCAUCG | CGAUGAUGGGAAAGGUUAUUU | 3249 |
| R-008397147-000Y | 1584 | 701 | GCCAAGUGGGUGGUAUAGA | UCUAUACCACCCACUUGGCUU | 3251 |
| R-008397147-000Y | 1584 | 701 | GCCAAGUGGGUGGUAUAGA | B GCCAAGUGGGUGGUAUAGATT B | 3250 |
| R-008397150-000E | 1871 | 702 | CGACUAGUUCAGUUGCUUG | B CGACUAGUUCAGUUGCUUGTT B | 3252 |
| R-008397150-000E | 1871 | 702 | CGACUAGUUCAGUUGCUUG | CAAGCAACUGAACUAGUCGUU | 3253 |
| R-008397153-000F | 999 | 703 | UUGGUUCACCAGUGGAUUC | B UUGGUUCACCAGUGGAUUCTT B | 3254 |
| R-008397153-000F | 999 | 703 | UUGGUUCACCAGUGGAUUC | GAAUCCACUGGUGAACCAAUU | 3255 |
| R-008397156-000G | 1400 | 704 | GUUCAGAACUGUCUUUGGA | UCCAAAGACAGUUCUGAACUU | 3257 |
| R-008397156-000G | 1400 | 704 | GUUCAGAACUGUCUUUGGA | B GUUCAGAACUGUCUUUGGATT B | 3256 |
| R-008397159-000H | 3180 | 705 | UGCUGUGAUACGAUGCUUC | GAAGCAUCGUAUCACAGCAUU | 3259 |
| R-008397159-000H | 3180 | 705 | UGCUGUGAUACGAUGCUUC | B UGCUGUGAUACGAUGCUUCTT B | 3258 |
| R-008397162-000P | 2569 | 706 | UCCAGGUGACAGCAAUCAG | CUGAUUGCUGUCACCUGGAUU | 3261 |
| R-008397162-000P | 2569 | 706 | UCCAGGUGACAGCAAUCAG | B UCCAGGUGACAGCAAUCAGTT B | 3260 |
| R-008397165-000R | 787 | 707 | UAUGGUCCAUCAGCUUUCU | AGAAAGCUGAUGGACCAUAUU | 3263 |
| R-008397165-000R | 787 | 707 | UAUGGUCCAUCAGCUUUCU | B UAUGGUCCAUCAGCUUUCUTT B | 3262 |
| R-008397168-000S | 1861 | 708 | UGCCAUUCCACGACUAGUU | B UGCCAUUCCACGACUAGUUTT B | 3264 |
| R-008397168-000S | 1861 | 708 | UGCCAUUCCACGACUAGUU | AACUAGUCGUGGAAUGGCAUU | 3265 |
| R-008397171-000Y | 1190 | 709 | AACCAAGAAAGCAAGCUCA | UGAGCUUGCUUUCUUGGUUUU | 3267 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397171-000Y | 1190 | 709 | AACCAAGAAAGCAAGCUCA | B AACCAAGAAAGCAAGCUCATT B | 3266 |
| R-008397174-000Z | 1557 | 710 | AUAAUUAUAAGAACAAGAU | AUCUUGUUCUUAUAAUUAUUU | 3269 |
| R-008397174-000Z | 1557 | 710 | AUAAUUAUAAGAACAAGAU | B AUAAUUAUAAGAACAAGAUTT B | 3268 |
| R-008397177-000A | 1751 | 711 | GUUAAGCUCUUACACCCAC | B GUUAAGCUCUUACACCCACTT B | 3270 |
| R-008397177-000A | 1751 | 711 | GUUAAGCUCUUACACCCAC | GUGGGUGUAAGAGCUUAACUU | 3271 |
| R-008397180-000G | 2897 | 712 | UUGAGUAAUGGUGUAGAAC | B UUGAGUAAUGGUGUAGAACTT B | 3272 |
| R-008397180-000G | 2897 | 712 | UUGAGUAAUGGUGUAGAAC | GUUCUACACCAUUACUCAAUU | 3273 |
| R-008397183-000H | 2217 | 713 | GUGUGGCGACAUAUGCAGC | GCUGCAUAUGUCGCCACACUU | 3275 |
| R-008397183-000H | 2217 | 713 | GUGUGGCGACAUAUGCAGC | B GUGUGGCGACAUAUGCAGCTT B | 3274 |
| R-008397186-000J | 2302 | 714 | GACCAGCUCUCUCUUCAGA | UCUGAAGAGAGAGCUGGUCUU | 3277 |
| R-008397186-000J | 2302 | 714 | GACCAGCUCUCUCUUCAGA | B GACCAGCUCUCUCUUCAGATT B | 3276 |
| R-008397189-000K | 1984 | 715 | UUGUACCGGAGCCCUUCAC | GUGAAGGGCUCCGGUACAAUU | 3279 |
| R-008397189-000K | 1984 | 715 | UUGUACCGGAGCCCUUCAC | B UUGUACCGGAGCCCUUCACTT B | 3278 |
| R-008397192-000S | 302 | 716 | AUGGCCAUGGAACCAGACA | B AUGGCCAUGGAACCAGACATT B | 3280 |
| R-008397192-000S | 302 | 716 | AUGGCCAUGGAACCAGACA | UGUCUGGUUCCAUGGCCAUUU | 3281 |
| R-008397195-000T | 2431 | 717 | UGGUGGAUAUGGCCAGGAU | B UGGUGGAUAUGGCCAGGAUTT B | 3282 |
| R-008397195-000T | 2431 | 717 | UGGUGGAUAUGGCCAGGAU | AUCCUGGCCAUAUCCACCAUU | 3283 |
| R-008397198-000U | 2183 | 718 | CCUCUGACAGAGUUACUUC | GAAGUAACUCUGUCAGAGGUU | 3285 |
| R-008397198-000U | 2183 | 718 | CCUCUGACAGAGUUACUUC | B CCUCUGACAGAGUUACUUCTT B | 3284 |
| R-008397201-000L | 2403 | 719 | AUGAUCCUAGCUAUCGUUC | GAACGAUAGCUAGGAUCAUUU | 3287 |
| R-008397201-000L | 2403 | 719 | AUGAUCCUAGCUAUCGUUC | B AUGAUCCUAGCUAUCGUUCTT B | 3286 |
| R-008397204-000M | 788 | 720 | AUGGUCCAUCAGCUUUCUA | B AUGGUCCAUCAGCUUUCUATT B | 3288 |
| R-008397204-000M | 788 | 720 | AUGGUCCAUCAGCUUUCUA | UAGAAAGCUGAUGGACCAUUU | 3289 |
| R-008397207-000N | 1476 | 721 | GGACUCUUGUUCAGCUUCU | B GGACUCUUGUUCAGCUUCUTT B | 3290 |
| R-008397207-000N | 1476 | 721 | GGACUCUUGUUCAGCUUCU | AGAAGCUGAACAAGAGUCCUU | 3291 |
| R-008397210-000V | 827 | 722 | GCUAUCAUGCGUUCUCCUC | B GCUAUCAUGCGUUCUCCUCTT B | 3292 |
| R-008397210-000V | 827 | 722 | GCUAUCAUGCGUUCUCCUC | GAGGAGAACGCAUGAUAGCUU | 3293 |
| R-008397213-000W | 2299 | 723 | GCUGACCAGCUCUCUCUUC | B GCUGACCAGCUCUCUCUUCTT B | 3294 |
| R-008397213-000W | 2299 | 723 | GCUGACCAGCUCUCUCUUC | GAAGAGAGAGCUGGUCAGCUU | 3295 |
| R-008397216-000X | 1891 | 724 | UCGUGCACAUCAGGAUACC | B UCGUGCACAUCAGGAUACCTT B | 3296 |
| R-008397216-000X | 1891 | 724 | UCGUGCACAUCAGGAUACC | GGUAUCCUGAUGUGCACGAUU | 3297 |
| R-008397219-000Y | 2196 | 725 | UACUUCACUCUAGGAAUGA | UCAUUCCUAGAGUGAAGUAUU | 3299 |
| R-008397219-000Y | 2196 | 725 | UACUUCACUCUAGGAAUGA | B UACUUCACUCUAGGAAUGATT B | 3298 |
| R-008397222-000E | 663 | 726 | UGAAACAUGCAGUUGUAAA | UUUACAACUGCAUGUUUCAUU | 3301 |
| R-008397222-000E | 663 | 726 | UGAAACAUGCAGUUGUAAA | B UGAAACAUGCAGUUGUAAATT B | 3300 |
| R-008397225-000F | 1028 | 727 | UAUGCCAUUACAACUCUCC | GGAGAGUUGUAAUGGCAUAUU | 3303 |
| R-008397225-000F | 1028 | 727 | UAUGCCAUUACAACUCUCC | B UAUGCCAUUACAACUCUCCTT B | 3302 |
| R-008397228-000G | 2032 | 728 | UGUUAUCAGAGGACUAAAU | AUUUAGUCCUCUGAUAACAUU | 3305 |
| R-008397228-000G | 2032 | 728 | UGUUAUCAGAGGACUAAAU | B UGUUAUCAGAGGACUAAAUTT B | 3304 |
| R-008397231-000N | 1459 | 729 | GAUGGAAGGUCUCCUUGGG | B GAUGGAAGGUCUCCUUGGGTT B | 3306 |
| R-008397231-000N | 1459 | 729 | GAUGGAAGGUCUCCUUGGG | CCCAAGGAGACCUUCCAUCUU | 3307 |
| R-008397234-000P | 2095 | 730 | CAUCCAAAGAGUAGCUGCA | UGCAGCUACUCUUUGGAUGUU | 3309 |
| R-008397234-000P | 2095 | 730 | CAUCCAAAGAGUAGCUGCA | B CAUCCAAAGAGUAGCUGCATT B | 3308 |
| R-008397237-000R | 1686 | 731 | GCCGACACCAAGAAGCAGA | B GCCGACACCAAGAAGCAGATT B | 3310 |
| R-008397237-000R | 1686 | 731 | GCCGACACCAAGAAGCAGA | UCUGCUUCUUGGUGUCGGCUU | 3311 |
| R-008397240-000X | 1412 | 732 | CUUUGGACUCUCAGGAAUC | B CUUUGGACUCUCAGGAAUCTT B | 3312 |
| R-008397240-000X | 1412 | 732 | CUUUGGACUCUCAGGAAUC | GAUUCCUGAGAGUCCAAAGUU | 3313 |
| R-008397243-000Y | 2473 | 733 | GGAACAUGAGAUGGGUGGC | GCCACCCAUCUCAUGUUCCUU | 3315 |
| R-008397243-000Y | 2473 | 733 | GGAACAUGAGAUGGGUGGC | B GGAACAUGAGAUGGGUGGCTT B | 3314 |
| R-008397246-000Z | 1080 | 734 | UGGCAGUGCGUUUAGCUGG | CCAGCUAAACGCACUGCCAUU | 3317 |
| R-008397246-000Z | 1080 | 734 | UGGCAGUGCGUUUAGCUGG | B UGGCAGUGCGUUUAGCUGGTT B | 3316 |
| R-008397249-000A | 2143 | 735 | GGAAGCUGCAGAAGCUAUU | AAUAGCUUCUGCAGCUUCCUU | 3319 |
| R-008397249-000A | 2143 | 735 | GGAAGCUGCAGAAGCUAUU | B GGAAGCUGCAGAAGCUAUUTT B | 3318 |
| R-008397252-000G | 2203 | 736 | CUCUAGGAAUGAAGGUGUG | B CUCUAGGAAUGAAGGUGUGTT B | 3320 |
| R-008397252-000G | 2203 | 736 | CUCUAGGAAUGAAGGUGUG | CACACCUUCAUUCCUAGAGUU | 3321 |
| R-008397255-000H | 548 | 737 | GUACGAGCUGCUAUGUUCC | B GUACGAGCUGCUAUGUUCCTT B | 3322 |
| R-008397255-000H | 548 | 737 | GUACGAGCUGCUAUGUUCC | GGAACAUAGCAGCUCGUACUU | 3323 |
| R-008397258-000J | 2050 | 45 | UACCAUUCCAUUGUUUGUG | CACAAACAAUGGAAUGGUAUU | 3325 |
| R-008397258-000J | 2050 | 45 | UACCAUUCCAUUGUUUGUG | B UACCAUUCCAUUGUUUGUGTT B | 3324 |
| R-008397261-000R | 1867 | 738 | UCCACGACUAGUUCAGUUG | B UCCACGACUAGUUCAGUUGTT B | 3326 |
| R-008397261-000R | 1867 | 738 | UCCACGACUAGUUCAGUUG | CAACUGAACUAGUCGUGGAUU | 3327 |
| R-008397264-000S | 842 | 739 | CCUCAGAUGGUGUCUGCUA | B CCUCAGAUGGUGUCUGCUATT B | 3328 |
| R-008397264-000S | 842 | 739 | CCUCAGAUGGUGUCUGCUA | UAGCAGACACCAUCUGAGGUU | 3329 |
| R-008397267-000T | 2120 | 740 | CUCUGUGAACUUGCUCAGG | CCUGAGCAAGUUCACAGAGUU | 3331 |
| R-008397267-000T | 2120 | 740 | CUCUGUGAACUUGCUCAGG | B CUCUGUGAACUUGCUCAGGTT B | 3330 |
| R-008397270-000Z | 782 | 741 | GCAGUUAUGGUCCAUCAGC | B GCAGUUAUGGUCCAUCAGCTT B | 3332 |
| R-008397270-000Z | 782 | 741 | GCAGUUAUGGUCCAUCAGC | GCUGAUGGACCAUAACUGCUU | 3333 |
| R-008397273-000A | 1758 | 742 | UCUUACACCCACCAUCCCA | UGGGAUGGUGGGUGUAAGAUU | 3335 |
| R-008397273-000A | 1758 | 742 | UCUUACACCCACCAUCCCA | B UCUUACACCCACCAUCCCATT B | 3334 |
| R-008397276-000B | 2396 | 743 | CGCCAGGAUGAUCCUAGCU | B CGCCAGGAUGAUCCUAGCUTT B | 3336 |
| R-008397276-000B | 2396 | 743 | CGCCAGGAUGAUCCUAGCU | AGCUAGGAUCAUCCUGGCGUU | 3337 |
| R-008397279-000C | 1373 | 744 | CACCUGACAGAUCCAAGUC | GACUUGGAUCUGUCAGGUGUU | 3339 |
| R-008397279-000C | 1373 | 744 | CACCUGACAGAUCCAAGUC | B CACCUGACAGAUCCAAGUCTT B | 3338 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397282-000J | 1518 | 745 | UCACCUGUGCAGCUGGAAU | B UCACCUGUGCAGCUGGAAUTT B | 3340 |
| R-008397282-000J | 1518 | 745 | UCACCUGUGCAGCUGGAAU | AUUCCAGCUGCACAGGUGAUU | 3341 |
| R-008397285-000K | 2557 | 746 | GGAUGGGCUGCCUCCAGGU | ACCUGGAGGCAGCCCAUCCUU | 3343 |
| R-008397285-000K | 2557 | 746 | GGAUGGGCUGCCUCCAGGU | B GGAUGGGCUGCCUCCAGGUTT B | 3342 |
| R-008397288-000L | 1987 | 747 | UACCGGAGCCCUUCACAUC | B UACCGGAGCCCUUCACAUCTT B | 3344 |
| R-008397288-000L | 1987 | 747 | UACCGGAGCCCUUCACAUC | GAUGUGAAGGGCUCCGGUAUU | 3345 |
| R-008397291-000T | 568 | 748 | UGAGACAUUAGAUGAGGGC | GCCCUCAUCUAAUGUCUCAUU | 3347 |
| R-008397291-000T | 568 | 748 | UGAGACAUUAGAUGAGGGC | B UGAGACAUUAGAUGAGGGCTT B | 3346 |
| R-008397294-000U | 2201 | 749 | CACUCUAGGAAUGAAGGUG | B CACUCUAGGAAUGAAGGUGTT B | 3348 |
| R-008397294-000U | 2201 | 749 | CACUCUAGGAAUGAAGGUG | CACCUUCAUUCCUAGAGUGUU | 3349 |
| R-008397297-000V | 609 | 750 | UUGAUGCUGCUCAUCCCAC | GUGGGAUGAGCAGCAUCAAUU | 3351 |
| R-008397297-000V | 609 | 750 | UUGAUGCUGCUCAUCCCAC | B UUGAUGCUGCUCAUCCCACTT B | 3350 |
| R-008397300-000M | 400 | 751 | UUCUCUGAGUGGUAAAGGC | GCCUUUACCACUCAGAGAAUU | 3353 |
| R-008397300-000M | 400 | 751 | UUCUCUGAGUGGUAAAGGC | B UUCUCUGAGUGGUAAAGGCTT B | 3352 |
| R-008397303-000N | 331 | 752 | UGUUAGUCACUGGCAGCAA | UUGCUGCCAGUGACUAACAUU | 3355 |
| R-008397303-000N | 331 | 752 | UGUUAGUCACUGGCAGCAA | B UGUUAGUCACUGGCAGCAATT B | 3354 |
| R-008397306-000P | 1967 | 753 | GAAGAAAUAGUUGAAGGUU | AACCUUCAACUAUUUCUUCUU | 3357 |
| R-008397306-000P | 1967 | 753 | GAAGAAAUAGUUGAAGGUU | B GAAGAAAUAGUUGAAGGUUTT B | 3356 |
| R-008397309-000R | 2198 | 754 | CUUCACUCUAGGAAUGAAG | CUUCAUUCCUAGAGUGAAGUU | 3359 |
| R-008397309-000R | 2198 | 754 | CUUCACUCUAGGAAUGAAG | B CUUCACUCUAGGAAUGAAGTT B | 3358 |
| R-008397312-000X | 1493 | 755 | CUGGGUUCAGAUGAUAUAA | UUAUAUCAUCUGAACCCAGUU | 3361 |
| R-008397312-000X | 1493 | 755 | CUGGGUUCAGAUGAUAUAA | B CUGGGUUCAGAUGAUAUAATT B | 3360 |
| R-008397315-000Y | 2260 | 756 | GGACAAGCCACAAGAUUAC | GUAAUCUUGUGGCUUGUCCUU | 3363 |
| R-008397315-000Y | 2260 | 756 | GGACAAGCCACAAGAUUAC | B GGACAAGCCACAAGAUUACTT B | 3362 |
| R-008397318-000Z | 2496 | 757 | ACCCUGGUGCUGACUAUCC | B ACCCUGGUGCUGACUAUCCTT B | 3364 |
| R-008397318-000Z | 2496 | 757 | ACCCUGGUGCUGACUAUCC | GGAUAGUCAGCACCAGGGUUU | 3365 |
| R-008397321-000F | 2361 | 758 | UUGAUAUUGGUGCCCAGGG | B UUGAUAUUGGUGCCCAGGGTT B | 3366 |
| R-008397321-000F | 2361 | 758 | UUGAUAUUGGUGCCCAGGG | CCCUGGGCACCAAUAUCAAUU | 3367 |
| R-008397324-000G | 443 | 759 | ACCUCCCAAGUCCUGUAUG | CAUACAGGACUUGGGAGGUUU | 3369 |
| R-008397324-000G | 443 | 759 | ACCUCCCAAGUCCUGUAUG | B ACCUCCCAAGUCCUGUAUGTT B | 3368 |
| R-008397327-000H | 523 | 760 | GUAUGCAAUGACUCGAGCU | B GUAUGCAAUGACUCGAGCUTT B | 3370 |
| R-008397327-000H | 523 | 760 | GUAUGCAAUGACUCGAGCU | AGCUCGAGUCAUUGCAUACUU | 3371 |
| R-008397330-000P | 1742 | 761 | CCAGUUGUGGUUAAGCUCU | B CCAGUUGUGGUUAAGCUCUTT B | 3372 |
| R-008397330-000P | 1742 | 761 | CCAGUUGUGGUUAAGCUCU | AGAGCUUAACCACAACUGGUU | 3373 |
| R-008397333-000R | 530 | 762 | AUGACUCGAGCUCAGAGGG | B AUGACUCGAGCUCAGAGGGTT B | 3374 |
| R-008397333-000R | 530 | 762 | AUGACUCGAGCUCAGAGGG | CCCUCUGAGCUCGAGUCAUUU | 3375 |
| R-008397336-000S | 3169 | 763 | UUGUUGUAACCUGCUGUGA | B UUGUUGUAACCUGCUGUGATT B | 3376 |
| R-008397336-000S | 3169 | 763 | UUGUUGUAACCUGCUGUGA | UCACAGCAGGUUACAACAAUU | 3377 |
| R-008397339-000T | 1385 | 764 | CCAAGUCAACGUCUUGUUC | B CCAAGUCAACGUCUUGUUCTT B | 3378 |
| R-008397339-000T | 1385 | 764 | CCAAGUCAACGUCUUGUUC | GAACAAGACGUUGACUUGGUU | 3379 |
| R-008397342-000Z | 2123 | 131 | UGUGAACUUGCUCAGGACA | B UGUGAACUUGCUCAGGACATT B | 3380 |
| R-008397342-000Z | 2123 | 131 | UGUGAACUUGCUCAGGACA | UGUCCUGAGCAAGUUCACAUU | 3381 |
| R-008397345-000A | 2036 | 765 | AUCAGAGGACUAAAUACCA | B AUCAGAGGACUAAAUACCATT B | 3382 |
| R-008397345-000A | 2036 | 765 | AUCAGAGGACUAAAUACCA | UGGUAUUUAGUCCUCUGAUUU | 3383 |
| R-008397348-000B | 3088 | 766 | UGUAUGGGUAGGGUAAAUC | GAUUUACCCUACCCAUACAUU | 3385 |
| R-008397348-000B | 3088 | 766 | UGUAUGGGUAGGGUAAAUC | B UGUAUGGGUAGGGUAAAUCTT B | 3384 |
| R-008397351-000H | 2051 | 56 | ACCAUUCCAUUGUUUGUGC | GCACAAACAAUGGAAUGGUUU | 3387 |
| R-008397351-000H | 2051 | 56 | ACCAUUCCAUUGUUUGUGC | B ACCAUUCCAUUGUUUGUGCTT B | 3386 |
| R-008397354-000J | 288 | 170 | UGAUGGAGUUGGACAUGGC | GCCAUGUCCAACUCCAUCAUU | 3389 |
| R-008397354-000J | 288 | 170 | UGAUGGAGUUGGACAUGGC | B UGAUGGAGUUGGACAUGGCTT B | 3388 |
| R-008397357-000K | 1850 | 767 | CGUGAGCAGGGUGCCAUUC | B CGUGAGCAGGGUGCCAUUCTT B | 3390 |
| R-008397357-000K | 1850 | 767 | CGUGAGCAGGGUGCCAUUC | GAAUGGCACCCUGCUCACUU | 3391 |
| R-008397360-000S | 2548 | 82 | GGACCUCAUGGAUGGGCUG | B GGACCUCAUGGAUGGGCUGTT B | 3392 |
| R-008397360-000S | 2548 | 82 | GGACCUCAUGGAUGGGCUG | CAGCCCAUCCAUGAGGUCCUU | 3393 |
| R-008397363-000T | 2518 | 768 | UGAUGGGCUGCCAGAUCUG | B UGAUGGGCUGCCAGAUCUGTT B | 3394 |
| R-008397363-000T | 2518 | 768 | UGAUGGGCUGCCAGAUCUG | CAGAUCUGGCAGCCCAUCAUU | 3395 |
| R-008397366-000U | 1886 | 769 | CUUGUUCGUGCACAUCAGG | B CUUGUUCGUGCACAUCAGGTT B | 3396 |
| R-008397366-000U | 1886 | 769 | CUUGUUCGUGCACAUCAGG | CCUGAUGUGCACGAACAAGUU | 3397 |
| R-008397369-000V | 650 | 770 | CCAUCACAGAUGCUGAAAC | GUUUCAGCAUCUGUGAUGGUU | 3399 |
| R-008397369-000V | 650 | 770 | CCAUCACAGAUGCUGAAAC | B CCAUCACAGAUGCUGAAACTT B | 3398 |
| R-008397372-000B | 3139 | 771 | ACAGUUUACCAGUUGCCUU | AAGGCAACUGGUAAACUGUUU | 3401 |
| R-008397372-000B | 3139 | 771 | ACAGUUUACCAGUUGCCUU | B ACAGUUUACCAGUUGCCUUTT B | 3400 |
| R-008397375-000C | 2025 | 772 | ACCGAAUUGUUAUCAGAGG | CCUCUGAUAACAAUUCGGUUU | 3403 |
| R-008397375-000C | 2025 | 772 | ACCGAAUUGUUAUCAGAGG | B ACCGAAUUGUUAUCAGAGGTT B | 3402 |
| R-008397378-000D | 1082 | 773 | GCAGUGCGUUUAGCUGGUG | CACCAGCUAAACGCACUGCUU | 3405 |
| R-008397378-000D | 1082 | 773 | GCAGUGCGUUUAGCUGGUG | B GCAGUGCGUUUAGCUGGUGTT B | 3404 |
| R-008397381-000K | 2475 | 774 | AACAUGAGUGGUGGCCA | UGGCCACCCAUCUCAUGUUUU | 3407 |
| R-008397381-000K | 2475 | 774 | AACAUGAGUGGUGGCCA | B AACAUGAGUGGUGGCCATT B | 3406 |
| R-008397384-000L | 1375 | 775 | CCUGACAGAUCCAAGUCAA | UUGACUUGGAUCUGUCAGGUU | 3409 |
| R-008397384-000L | 1375 | 775 | CCUGACAGAUCCAAGUCAA | B CCUGACAGAUCCAAGUCAATT B | 3408 |
| R-008397387-000M | 2013 | 776 | GGGAUGUUCACAACCGAAU | B GGGAUGUUCACAACCGAAUTT B | 3410 |
| R-008397387-000M | 2013 | 776 | GGGAUGUUCACAACCGAAU | AUUCGGUUGUGAACAUCCCUU | 3411 |
| R-008397390-000U | 1236 | 41 | CUUUAGUAAAUAUAAUGAG | CUCAUUAUAUUUACUAAAGUU | 3413 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397390-000U | 1236 | 41 | CUUUAGUAAAUAUAAUGAG | B CUUUAGUAAAUAUAAUGAGTT B | 3412 |
| R-008397393-000V | 1653 | 128 | AGCCUGCCAUCUGUGCUCU | B AGCCUGCCAUCUGUGCUCUTT B | 3414 |
| R-008397393-000V | 1653 | 128 | AGCCUGCCAUCUGUGCUCU | AGAGCACAGAUGGCAGGCUUU | 3415 |
| R-008397396-000W | 1802 | 777 | GGAUUGAUUCGAAAUCUUG | B GGAUUGAUUCGAAAUCUUGTT B | 3416 |
| R-008397396-000W | 1802 | 777 | GGAUUGAUUCGAAAUCUUG | CAAGAUUUCGAAUCAAUCCUU | 3417 |
| R-008397399-000X | 2144 | 778 | GAAGCUGCAGAAGCUAUUG | CAAUAGCUUCUGCAGCUUCUU | 3419 |
| R-008397399-000X | 2144 | 778 | GAAGCUGCAGAAGCUAUUG | B GAAGCUGCAGAAGCUAUUGTT B | 3418 |
| R-008397402-000P | 529 | 779 | AAUGACUCGAGCUCAGAGG | B AAUGACUCGAGCUCAGAGGTT B | 3420 |
| R-008397402-000P | 529 | 779 | AAUGACUCGAGCUCAGAGG | CCUCUGAGCUCGAGUCAUUUU | 3421 |
| R-008397405-000R | 1482 | 780 | UUGUUCAGCUUCUGGGUUC | GAACCCAGAAGCUGAACAUU | 3423 |
| R-008397405-000R | 1482 | 780 | UUGUUCAGCUUCUGGGUUC | B UUGUUCAGCUUCUGGGUUCTT B | 3422 |
| R-008397408-000S | 1546 | 781 | CCUCACUUGCAAUAAUUAU | B CCUCACUUGCAAUAAUUAUTT B | 3424 |
| R-008397408-000S | 1546 | 781 | CCUCACUUGCAAUAAUUAU | AUAAUUAUGCAAGUGAGGUU | 3425 |
| R-008397411-000Y | 845 | 782 | CAGAUGGUGUCUGCUAUUG | CAAUAGCAGACACCAUCUGUU | 3427 |
| R-008397411-000Y | 845 | 782 | CAGAUGGUGUCUGCUAUUG | B CAGAUGGUGUCUGCUAUUGTT B | 3426 |
| R-008397414-000Z | 487 | 783 | CUUCACUCAAGAACAAGUA | B CUUCACUCAAGAACAAGUATT B | 3428 |
| R-008397414-000Z | 487 | 783 | CUUCACUCAAGAACAAGUA | UACUUGUUCUUGAGUGAAGUU | 3429 |
| R-008397417-000A | 652 | 784 | AUCACAGAUGCUGAAACAU | AUGUUUCAGCAUCUGUGAUUU | 3431 |
| R-008397417-000A | 652 | 784 | AUCACAGAUGCUGAAACAU | B AUCACAGAUGCUGAAACAUTT B | 3430 |
| R-008397420-000G | 1720 | 785 | AGUUCGCCUUCACUAUGGA | UCCAUAGUGAAGGCGAACUUU | 3433 |
| R-008397420-000G | 1720 | 785 | AGUUCGCCUUCACUAUGGA | B AGUUCGCCUUCACUAUGGATT B | 3432 |
| R-008397423-000H | 951 | 786 | UACUGGCCAUCUUUAAGUC | GACUUAAAGAUGGCCAGUAUU | 3435 |
| R-008397423-000H | 951 | 786 | UACUGGCCAUCUUUAAGUC | B UACUGGCCAUCUUUAAGUCTT B | 3434 |
| R-008397426-000J | 1232 | 787 | CAAGCUUUAGUAAAUAUAA | UUAUAUUUACUAAAGCUUGUU | 3437 |
| R-008397426-000J | 1232 | 787 | CAAGCUUUAGUAAAUAUAA | B CAAGCUUUAGUAAAUAUAATT B | 3436 |
| R-008397429-000K | 2269 | 28 | ACAAGAUUACAAGAAACGG | B ACAAGAUUACAAGAAACGGTT B | 3438 |
| R-008397429-000K | 2269 | 28 | ACAAGAUUACAAGAAACGG | CCGUUUCUUGUAAUCUUGUUU | 3439 |
| R-008397432-000S | 2265 | 788 | AGCCACAAGAUUACAAGAA | B AGCCACAAGAUUACAAGAATT B | 3440 |
| R-008397432-000S | 2265 | 788 | AGCCACAAGAUUACAAGAA | UUCUUGUAAUCUUGUGGCUUU | 3441 |
| R-008397435-000T | 1698 | 789 | AAGCAGAGAUGGCCCAGAA | B AAGCAGAGAUGGCCCAGAATT B | 3442 |
| R-008397435-000T | 1698 | 789 | AAGCAGAGAUGGCCCAGAA | UUCUGGGCCAUCUCUGCUUUU | 3443 |
| R-008397438-000U | 701 | 790 | GAUGCAGAACUUGCCACAC | GUGUGGCAAGUUCUGCAUCUU | 3445 |
| R-008397438-000U | 701 | 790 | GAUGCAGAACUUGCCACAC | B GAUGCAGAACUUGCCACACTT B | 3444 |
| R-008397441-000A | 1428 | 791 | AUCUUUCAGAUGCUGCAAC | GUUGCAGCAUCUGAAAGAUUU | 3447 |
| R-008397441-000A | 1428 | 791 | AUCUUUCAGAUGCUGCAAC | B AUCUUUCAGAUGCUGCAACTT B | 3446 |
| R-008397444-000B | 1930 | 792 | UGGGACACAGCAGCAAUUU | B UGGGACACAGCAGCAAUUUTT B | 3448 |
| R-008397444-000B | 1930 | 792 | UGGGACACAGCAGCAAUUU | AAAUUGCUGCUGUGUCCCAUU | 3449 |
| R-008397447-000C | 1379 | 793 | ACAGAUCCAAGUCAACGUC | GACGUUGACUUGGAUCUGUUU | 3451 |
| R-008397447-000C | 1379 | 793 | ACAGAUCCAAGUCAACGUC | B ACAGAUCCAAGUCAACGUCTT B | 3450 |
| R-008397450-000J | 1936 | 794 | ACAGCAGCAAUUUGUGGAG | B ACAGCAGCAAUUUGUGGAGTT B | 3452 |
| R-008397450-000J | 1936 | 794 | ACAGCAGCAAUUUGUGGAG | CUCCACAAAUUGCUGCUGUUU | 3453 |
| R-008397453-000K | 1441 | 795 | UGCAACUAAACAGGAAGGG | CCCUUCCUGUUUAGUUGCAUU | 3455 |
| R-008397453-000K | 1441 | 795 | UGCAACUAAACAGGAAGGG | B UGCAACUAAACAGGAAGGGTT B | 3454 |
| R-008397456-000L | 2132 | 796 | GCUCAGGACAAGGAAGCUG | CAGCUUCCUUGUCCUGAGCUU | 3457 |
| R-008397456-000L | 2132 | 796 | GCUCAGGACAAGGAAGCUG | B GCUCAGGACAAGGAAGCUGTT B | 3456 |
| R-008397459-000M | 2443 | 165 | CCAGGAUGCCUUGGGUAUG | B CCAGGAUGCCUUGGGUAUGTT B | 3458 |
| R-008397459-000M | 2443 | 165 | CCAGGAUGCCUUGGGUAUG | CAUACCCAAGGCAUCCUGGUU | 3459 |
| R-008397462-000U | 1800 | 163 | UUGGAUUGAUUCGAAAUCU | AGAUUUCGAAUCAAUCCAAUU | 3461 |
| R-008397462-000U | 1800 | 163 | UUGGAUUGAUUCGAAAUCU | B UUGGAUUGAUUCGAAAUCUTT B | 3460 |
| R-008397465-000V | 403 | 185 | UCUGAGUGGUAAAGGCAAU | AUUGCCUUUACCACUCAGAUU | 3463 |
| R-008397465-000V | 403 | 185 | UCUGAGUGGUAAAGGCAAU | B UCUGAGUGGUAAAGGCAAUTT B | 3462 |
| R-008397468-000W | 1007 | 105 | CCAGUGGAUUCUGUGUUGU | ACAACACAGAAUCCACUGGUU | 3465 |
| R-008397468-000W | 1007 | 105 | CCAGUGGAUUCUGUGUUGU | B CCAGUGGAUUCUGUGUUGUTT B | 3464 |
| R-008397471-000C | 1057 | 113 | AUUACAUCAAGAAGGAGCU | AGCUCCUUCUUGAUGUAAUUU | 3467 |
| R-008397471-000C | 1057 | 113 | AUUACAUCAAGAAGGAGCU | B AUUACAUCAAGAAGGAGCUTT B | 3466 |
| R-008397474-000D | 2267 | 87 | CCACAAGAUUACAAGAAAC | B CCACAAGAUUACAAGAAACTT B | 3468 |
| R-008397474-000D | 2267 | 87 | CCACAAGAUUACAAGAAAC | GUUUCUUGUAAUCUUGUGGUU | 3469 |
| R-008397477-000E | 1240 | 158 | AGUAAAUAUAAUGAGGACC | B AGUAAAUAUAAUGAGGACCTT B | 3470 |
| R-008397477-000E | 1240 | 158 | AGUAAAUAUAAUGAGGACC | GGUCCUCAUUAUAUUUACUUU | 3471 |
| R-008397480-000L | 2043 | 797 | GACUAAAUACCAUUCCAUU | AAUGGAAUGGUAUUUAGUCUU | 3473 |
| R-008397480-000L | 2043 | 797 | GACUAAAUACCAUUCCAUU | B GACUAAAUACCAUUCCAUUTT B | 3472 |
| R-008397483-000M | 608 | 798 | UUUGAUGCUGCUCAUCCCA | UGGGAUGAGCAGCAUCAAAUU | 3475 |
| R-008397483-000M | 608 | 798 | UUUGAUGCUGCUCAUCCCA | B UUUGAUGCUGCUCAUCCCATT B | 3474 |
| R-008397486-000N | 341 | 799 | UGGCAGCAACAGUCUUACC | B UGGCAGCAACAGUCUUACCTT B | 3476 |
| R-008397486-000N | 341 | 799 | UGGCAGCAACAGUCUUACC | GGUAAGACUGUUGCUGCCAUU | 3477 |
| R-008397489-000P | 1194 | 800 | AAGAAAGCAAGCUCAUCAU | B AAGAAAGCAAGCUCAUCAUTT B | 3478 |
| R-008397489-000P | 1194 | 800 | AAGAAAGCAAGCUCAUCAU | AUGAUGAGCUUGCUUUCUUUU | 3479 |
| R-008397492-000W | 2350 | 801 | UGAUCUUGGACUUGAUAUU | B UGAUCUUGGACUUGAUAUUTT B | 3480 |
| R-008397492-000W | 2350 | 801 | UGAUCUUGGACUUGAUAUU | AAUAUCAAGUCCAAGAUCAUU | 3481 |
| R-008397495-000X | 2948 | 802 | CUGAAUAAAGUGUAACAAU | B CUGAAUAAAGUGUAACAAUTT B | 3482 |
| R-008397495-000X | 2948 | 802 | CUGAAUAAAGUGUAACAAU | AUUGUUACACUUUAUUCAGUU | 3483 |
| R-008397507-000T | 2044 | 803 | ACUAAAUACCAUUCCAUUG | B ACUAAAUACCAUUCCAUUGTT B | 3484 |
| R-008397507-000T | 2044 | 803 | ACUAAAUACCAUUCCAUUG | CAAUGGAAUGGUAUUUAGUUU | 3485 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397510-000Z | 621 | 804 | AUCCCACUAAUGUCCAGCG | CGCUGGACAUUAGUGGGAUUU | 3487 |
| R-008397510-000Z | 621 | 804 | AUCCCACUAAUGUCCAGCG | B AUCCCACUAAUGUCCAGCGTT B | 3486 |
| R-008397513-000A | 384 | 805 | CCACUACCACAGCUCCUUC | B CCACUACCACAGCUCCUUCTT B | 3488 |
| R-008397513-000A | 384 | 805 | CCACUACCACAGCUCCUUC | GAAGGAGCUGUGGUAGUGGUU | 3489 |
| R-008397516-000B | 1898 | 806 | CAUCAGGAUACCCAGCGCC | B CAUCAGGAUACCCAGCGCCTT B | 3490 |
| R-008397516-000B | 1898 | 806 | CAUCAGGAUACCCAGCGCC | GGCGCUGGGUAUCCUGAUGUU | 3491 |
| R-008397519-000C | 1795 | 15 | UACUGUUGGAUUGAUUCGA | UCGAAUCAAUCCAACAGUAUU | 3493 |
| R-008397519-000C | 1795 | 15 | UACUGUUGGAUUGAUUCGA | B UACUGUUGGAUUGAUUCGATT B | 3492 |
| R-008397522-000J | 653 | 807 | UCACAGAUGCUGAAACAUG | CAUGUUUCAGCAUCUGUGAUU | 3495 |
| R-008397522-000J | 653 | 807 | UCACAGAUGCUGAAACAUG | B UCACAGAUGCUGAAACAUGTT B | 3494 |
| R-008397525-000K | 1846 | 808 | UUUGCGUGAGCAGGGUGCC | GGCACCCUGCUCACGCAAAUU | 3497 |
| R-008397525-000K | 1846 | 808 | UUUGCGUGAGCAGGGUGCC | B UUUGCGUGAGCAGGGUGCCTT B | 3496 |
| R-008397528-000L | 2348 | 809 | GCUGAUCUUGGACUUGAUA | UAUCAAGUCCAAGAUCAGCUU | 3499 |
| R-008397528-000L | 2348 | 809 | GCUGAUCUUGGACUUGAUA | B GCUGAUCUUGGACUUGAUATT B | 3498 |
| R-008397531-000T | 1798 | 19 | UGUUGGAUUGAUUCGAAAU | AUUUCGAAUCAAUCCAACAUU | 3501 |
| R-008397531-000T | 1798 | 19 | UGUUGGAUUGAUUCGAAAU | B UGUUGGAUUGAUUCGAAAUTT B | 3500 |
| R-008397534-000U | 1150 | 810 | GGCUAUUACGACAGACGC | B GGCUAUUACGACAGACUGCTT B | 3502 |
| R-008397534-000U | 1150 | 810 | GCUAUUACGACAGACGC | GCAGUCUGUCGUAAUAGCCUU | 3503 |
| R-008397537-000V | 1009 | 180 | AGUGGAUUCUGUGUUGUUU | AAACAACACAGAAUCCACUUU | 3505 |
| R-008397537-000V | 1009 | 180 | AGUGGAUUCUGUGUUGUUU | B AGUGGAUUCUGUGUUGUUUTT B | 3504 |
| R-008397540-000B | 654 | 178 | CACAGAUGCUGAAACAUGC | B CACAGAUGCUGAAACAUGCTT B | 3506 |
| R-008397540-000B | 654 | 178 | CACAGAUGCUGAAACAUGC | GCAUGUUUCAGCAUCUGUGUU | 3507 |
| R-008397543-000C | 298 | 811 | GGACAUGGCCAUGGAACCA | B GGACAUGGCCAUGGAACCATT B | 3508 |
| R-008397543-000C | 298 | 811 | GGACAUGGCCAUGGAACCA | UGGUUCCAUGGCCAUGUCCUU | 3509 |
| R-008397546-000D | 1568 | 812 | AACAAGAUGAUGGUCUGCC | B AACAAGAUGAUGGUCUGCCTT B | 3510 |
| R-008397546-000D | 1568 | 812 | AACAAGAUGAUGGUCUGCC | GGCAGACCAUCAUCUUGUUUU | 3511 |
| R-008397549-000E | 1058 | 813 | UUACAUCAAGAAGGAGCUA | B UUACAUCAAGAAGGAGCUATT B | 3512 |
| R-008397549-000E | 1058 | 813 | UUACAUCAAGAAGGAGCUA | UAGCUCCUUCUUGAUGUAAUU | 3513 |
| R-008397552-000L | 1835 | 814 | AAUCAUGCACCUUUGCGUG | B AAUCAUGCACCUUUGCGUGTT B | 3514 |
| R-008397552-000L | 1835 | 814 | AAUCAUGCACCUUUGCGUG | CACGCAAAGGUGCAUGAUUUU | 3515 |
| R-008397555-000M | 1832 | 815 | GCAAAUCAUGCACCUUUGC | B GCAAAUCAUGCACCUUUGCTT B | 3516 |
| R-008397555-000M | 1832 | 815 | GCAAAUCAUGCACCUUUGC | GCAAAGGUGCAUGAUUUGCUU | 3517 |
| R-008397558-000N | 2550 | 55 | ACCUCAUGGAUGGGCUGCC | GGCAGCCCAUCCAUGAGGUUU | 3519 |
| R-008397558-000N | 2550 | 55 | ACCUCAUGGAUGGGCUGCC | B ACCUCAUGGAUGGGCUGCCTT B | 3518 |
| R-008397561-000V | 406 | 816 | GAGUGGUAAAGGCAAUCCU | AGGAUUGCCUUUACCACUUU | 3521 |
| R-008397561-000V | 406 | 816 | GAGUGGUAAAGGCAAUCCU | B GAGUGGUAAAGGCAAUCCUTT B | 3520 |
| R-008397564-000W | 1723 | 817 | UCGCCUUCACUAUGGACUA | B UCGCCUUCACUAUGGACUATT B | 3522 |
| R-008397564-000W | 1723 | 817 | UCGCCUUCACUAUGGACUA | UAGUCCAUAGUGAAGGCGAUU | 3523 |
| R-008397567-000X | 371 | 818 | AUCCAUUCUGGUGCCACUA | UAGUGGCACCAGAAUGGAUU | 3525 |
| R-008397567-000X | 371 | 818 | AUCCAUUCUGGUGCCACUA | B AUCCAUUCUGGUGCCACUATT B | 3524 |
| R-008397570-000D | 1899 | 819 | AUCAGGAUACCCAGCGCCG | CGGCGCUGGGUAUCCUGAUUU | 3527 |
| R-008397570-000D | 1899 | 819 | AUCAGGAUACCCAGCGCCG | B AUCAGGAUACCCAGCGCCGTT B | 3526 |
| R-008397573-000E | 522 | 820 | AGUAUGCAAUGACUCGAGC | B AGUAUGCAAUGACUCGAGCTT B | 3528 |
| R-008397573-000E | 522 | 820 | AGUAUGCAAUGACUCGAGC | GCUCGAGUCAUUGCAUACUUU | 3529 |
| R-008397576-000F | 2285 | 821 | CGGCUUUCAGUUGAGCUGA | B CGGCUUUCAGUUGAGCUGATT B | 3530 |
| R-008397576-000F | 2285 | 821 | CGGCUUUCAGUUGAGCUGA | UCAGCUCAACUGAAAGCCGUU | 3531 |
| R-008397579-000G | 779 | 822 | GCUGCAGUUAUGGUCCAUC | GAUGGACCAUAACUGCAGCUU | 3533 |
| R-008397579-000G | 779 | 822 | GCUGCAGUUAUGGUCCAUC | B GCUGCAGUUAUGGUCCAUCTT B | 3532 |
| R-008397582-000N | 2896 | 823 | AUUGAGUAAUGGUGUAGAA | B AUUGAGUAAUGGUGUAGAATT B | 3534 |
| R-008397582-000N | 2896 | 823 | AUUGAGUAAUGGUGUAGAA | UUCUACACCAUUACUCAAUUU | 3535 |
| R-008397588-000R | 2943 | 824 | GUAAUCUGAAUAAAGUGUA | UACACUUUAUUCAGAUUACUU | 3537 |
| R-008397588-000R | 2943 | 824 | GUAAUCUGAAUAAAGUGUA | B GUAAUCUGAAUAAAGUGUATT B | 3536 |
| R-008397591-000X | 513 | 825 | UUGAUGGACAGUAUGCAAU | B UUGAUGGACAGUAUGCAAUTT B | 3538 |
| R-008397591-000X | 513 | 825 | UUGAUGGACAGUAUGCAAU | AUUGCAUACUGUCCAUCAAUU | 3539 |
| R-008397594-000Y | 3084 | 826 | GAUAUGUAUGGGUAGGGUA | B GAUAUGUAUGGGUAGGGUATT B | 3540 |
| R-008397594-000Y | 3084 | 826 | GAUAUGUAUGGGUAGGGUA | UACCCUACCCAUACAUAUCUU | 3541 |
| R-008397597-000Z | 1567 | 827 | GAACAAGAUGAUGGUCUGC | B GAACAAGAUGAUGGUCUGCTT B | 3542 |
| R-008397597-000Z | 1567 | 827 | GAACAAGAUGAUGGUCUGC | GCAGACCAUCAUCUUGUUCUU | 3543 |
| R-008397600-000S | 2034 | 828 | UUAUCAGAGGACUAAAUAC | B UUAUCAGAGGACUAAAUACTT B | 3544 |
| R-008397600-000S | 2034 | 828 | UUAUCAGAGGACUAAAUAC | GUAUUUAGUCCUCUGAUAAUU | 3545 |
| R-008397603-000T | 1003 | 829 | UUCACCAGUGGAUUCUGUG | B UUCACCAGUGGAUUCUGUGTT B | 3546 |
| R-008397603-000T | 1003 | 829 | UUCACCAGUGGAUUCUGUG | CACAGAAUCCACUGGUGAAUU | 3547 |
| R-008397606-000U | 1980 | 830 | AAGGUUGUACCGGAGCCCU | AGGGCUCCGGUACAACCUUUU | 3549 |
| R-008397606-000U | 1980 | 830 | AAGGUUGUACCGGAGCCCU | B AAGGUUGUACCGGAGCCCUTT B | 3548 |
| R-008397609-000V | 1340 | 831 | GUAGAAGCUGGUGGAAUGC | GCAUUCCACCAGCUUCUACUU | 3551 |
| R-008397609-000V | 1340 | 831 | GUAGAAGCUGGUGGAAUGC | B GUAGAAGCUGGUGGAAUGCTT B | 3550 |
| R-008397612-000B | 1437 | 832 | AUGCUGCAACUAAACAGGA | B AUGCUGCAACUAAACAGGATT B | 3552 |
| R-008397612-000B | 1437 | 832 | AUGCUGCAACUAAACAGGA | UCCUGUUUAGUUGCAGCAUUU | 3553 |
| R-008397615-000C | 2499 | 145 | CUGGUGCUGACUAUCCAGU | B CUGGUGCUGACUAUCCAGUTT B | 3554 |
| R-008397615-000C | 2499 | 145 | CUGGUGCUGACUAUCCAGU | ACUGGAUAGUCAGCACCAGUU | 3555 |
| R-008397618-000D | 785 | 64 | GUUAUGGUCCAUCAGCUUU | AAAGCUGAUGGACCAUAACUU | 3557 |
| R-008397618-000D | 785 | 64 | GUUAUGGUCCAUCAGCUUU | B GUUAUGGUCCAUCAGCUUUTT B | 3556 |
| R-008397621-000K | 2425 | 833 | UCACUCUGGUGGAUAUGGC | B UCACUCUGGUGGAUAUGGCTT B | 3558 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397621-000K | 2425 | 833 | UCACUCUGGUGGAUAUGGC | GCCAUAUCCACCAGAGUGAUU | 3559 |
| R-008397624-000L | 282 | 834 | CUGAUUUGAUGGAGUUGGA | UCCAACUCCAUCAAAUCAGUU | 3561 |
| R-008397624-000L | 282 | 834 | CUGAUUUGAUGGAGUUGGA | B CUGAUUUGAUGGAGUUGGATT B | 3560 |
| R-008397627-000M | 1206 | 835 | UCAUCAUACUGGCUAGUGG | B UCAUCAUACUGGCUAGUGGTT B | 3562 |
| R-008397627-000M | 1206 | 835 | UCAUCAUACUGGCUAGUGG | CCACUAGCCAGUAUGAUGAUU | 3563 |
| R-008397630-000U | 1885 | 836 | GCUUGUUCGUGCACAUCAG | CUGAUGUGCACGAACAAGCUU | 3565 |
| R-008397630-000U | 1885 | 836 | GCUUGUUCGUGCACAUCAG | B GCUUGUUCGUGCACAUCAGTT B | 3564 |
| R-008397633-000V | 1314 | 837 | UCUGCUCUAGUAAUAAGCC | B UCUGCUCUAGUAAUAAGCCTT B | 3566 |
| R-008397633-000V | 1314 | 837 | UCUGCUCUAGUAAUAAGCC | GGCUUAUUACUAGAGCAGAUU | 3567 |
| R-008397636-000W | 2388 | 174 | UUGGAUAUCGCCAGGAUGA | B UUGGAUAUCGCCAGGAUGATT B | 3568 |
| R-008397636-000W | 2388 | 174 | UUGGAUAUCGCCAGGAUGA | UCAUCCUGGCGAUAUCCAAUU | 3569 |
| R-008397639-000X | 1308 | 838 | UAUCUGUCUGCUCUAGUAA | B UAUCUGUCUGCUCUAGUAATT B | 3570 |
| R-008397639-000X | 1308 | 838 | UAUCUGUCUGCUCUAGUAA | UUACUAGAGCAGACAGAUAUU | 3571 |
| R-008397642-000D | 1200 | 839 | GCAAGCUCAUCAUACUGGC | GCCAGUAUGAUGAGCUUGCUU | 3573 |
| R-008397642-000D | 1200 | 839 | GCAAGCUCAUCAUACUGGC | B GCAAGCUCAUCAUACUGGCTT B | 3572 |
| R-008397645-000E | 543 | 840 | AGAGGGUACGAGCUGCUAU | B AGAGGGUACGAGCUGCUAUTT B | 3574 |
| R-008397645-000E | 543 | 840 | AGAGGGUACGAGCUGCUAU | AUAGCAGCUCGUACCCUCUUU | 3575 |
| R-008397648-000F | 1609 | 841 | UGUGCGUACUGUCCUUCGG | B UGUGCGUACUGUCCUUCGGTT B | 3576 |
| R-008397648-000F | 1609 | 841 | UGUGCGUACUGUCCUUCGG | CCGAAGGACAGUACGCACAUU | 3577 |
| R-008397651-000M | 1453 | 842 | GGAAGGGAUGGAAGGUCUC | B GGAAGGGAUGGAAGGUCUCTT B | 3578 |
| R-008397651-000M | 1453 | 842 | GGAAGGGAUGGAAGGUCUC | GAGACCUUCCAUCCCUUCCUU | 3579 |
| R-008397654-000N | 2127 | 138 | AACUUGCUCAGGACAAGGA | B AACUUGCUCAGGACAAGGATT B | 3580 |
| R-008397654-000N | 2127 | 138 | AACUUGCUCAGGACAAGGA | UCCUUGUCCUGAGCAAGUUUU | 3581 |
| R-008397657-000P | 833 | 843 | AUGCGUUCUCCUCAGAUGG | B AUGCGUUCUCCUCAGAUGGTT B | 3582 |
| R-008397657-000P | 833 | 843 | AUGCGUUCUCCUCAGAUGG | CCAUCUGAGGAGAACGCAUUU | 3583 |
| R-008397660-000W | 2188 | 844 | GACAGAGUUACUUCACUCU | B GACAGAGUUACUUCACUCUTT B | 3584 |
| R-008397660-000W | 2188 | 844 | GACAGAGUUACUUCACUCU | AGAGUGAAGUAACUCUGUCUU | 3585 |
| R-008397663-000X | 1148 | 845 | UUGGCUAUUACGACAGACU | B UUGGCUAUUACGACAGACUTT B | 3586 |
| R-008397663-000X | 1148 | 845 | UUGGCUAUUACGACAGACU | AGUCUGUCGUAAUAGCCAAUU | 3587 |
| R-008397666-000Y | 1736 | 846 | GGACUACCAGUUGUGGUUA | B GGACUACCAGUUGUGGUUATT B | 3588 |
| R-008397666-000Y | 1736 | 846 | GGACUACCAGUUGUGGUUA | UAACCACAACUGGUAGUCCUU | 3589 |
| R-008397669-000Z | 1401 | 847 | UUCAGAACUGUCUUUGGAC | GUCCAAAGACAGUUCUGAAUU | 3591 |
| R-008397669-000Z | 1401 | 847 | UUCAGAACUGUCUUUGGAC | B UUCAGAACUGUCUUUGGACTT B | 3590 |
| R-008397672-000F | 1677 | 848 | AUCUGACCAGCCGACACCA | UGGUGUCGGCUGGUCAGAUUU | 3593 |
| R-008397672-000F | 1677 | 848 | AUCUGACCAGCCGACACCA | B AUCUGACCAGCCGACACCATT B | 3592 |
| R-008397675-000G | 1934 | 849 | ACACAGCAGCAAUUUGUGG | B ACACAGCAGCAAUUUGUGGTT B | 3594 |
| R-008397675-000G | 1934 | 849 | ACACAGCAGCAAUUUGUGG | CCACAAAUUGCUGCUGUGUUU | 3595 |
| R-008397678-000H | 388 | 850 | UACCACAGCUCCUUCUCUG | CAGAGAAGGAGCUGUGGUAUU | 3597 |
| R-008397678-000H | 388 | 850 | UACCACAGCUCCUUCUCUG | B UACCACAGCUCCUUCUCUGTT B | 3596 |
| R-008397681-000P | 1920 | 851 | CGUCCAUGGGUGGGACACA | B CGUCCAUGGGUGGGACACATT B | 3598 |
| R-008397681-000P | 1920 | 851 | CGUCCAUGGGUGGGACACA | UGUGUCCCACCCAUGGACGUU | 3599 |
| R-008397684-000R | 1747 | 852 | UGUGGUUAAGCUCUUACAC | GUGUAAGAGCUUAACCACAUU | 3601 |
| R-008397684-000R | 1747 | 852 | UGUGGUUAAGCUCUUACAC | B UGUGGUUAAGCUCUUACACTT B | 3600 |
| R-008397687-000S | 861 | 853 | UUGUACGUACCAUGCAGAA | B UUGUACGUACCAUGCAGAATT B | 3602 |
| R-008397687-000S | 861 | 853 | UUGUACGUACCAUGCAGAA | UUCUGCAUGGUACGUACAAUU | 3603 |
| R-008397690-000Y | 1904 | 854 | GAUACCCAGCGCCGUACGU | B GAUACCCAGCGCCGUACGUTT B | 3604 |
| R-008397690-000Y | 1904 | 854 | GAUACCCAGCGCCGUACGU | ACGUACGGCGCUGGGUAUCUU | 3605 |
| R-008397693-000Z | 831 | 855 | UCAUGCGUUCUCCUCAGAU | B UCAUGCGUUCUCCUCAGAUTT B | 3606 |
| R-008397693-000Z | 831 | 855 | UCAUGCGUUCUCCUCAGAU | AUCUGAGGAGAACGCAUGAUU | 3607 |
| R-008397696-000A | 1895 | 856 | GCAUCAGGAUACCCAGC | GCUGGGUAUCCUGAUGUGCUU | 3609 |
| R-008397696-000A | 1895 | 856 | GCAUCAGGAUACCCAGC | B GCAUCAGGAUACCCAGCTT B | 3608 |
| R-008397699-000B | 2273 | 857 | GAUUACAAGAAACGGCUUU | AAAGCCGUUUCUUGUAAUCUU | 3611 |
| R-008397699-000B | 2273 | 857 | GAUUACAAGAAACGGCUUU | B GAUUACAAGAAACGGCUUUTT B | 3610 |
| R-008397702-000U | 1738 | 858 | ACUACCAGUUGUGGUUAAG | B ACUACCAGUUGUGGUUAAGTT B | 3612 |
| R-008397702-000U | 1738 | 858 | ACUACCAGUUGUGGUUAAG | CUUAACCACAACUGGUAGUUU | 3613 |
| R-008397705-000V | 1395 | 859 | GUCUUGUUCAGAACUGUCU | B GUCUUGUUCAGAACUGUCUTT B | 3614 |
| R-008397705-000V | 1395 | 859 | GUCUUGUUCAGAACUGUCU | AGACAGUUCUGAACAAGACUU | 3615 |
| R-008397708-000W | 1675 | 860 | UCAUCUGACCAGCCGACAC | B UCAUCUGACCAGCCGACACTT B | 3616 |
| R-008397708-000W | 1675 | 860 | UCAUCUGACCAGCCGACAC | GUGUCGGCUGGUCAGAUGAUU | 3617 |
| R-008397711-000C | 1845 | 861 | CUUUGCGUGAGCAGGGUGC | B CUUUGCGUGAGCAGGGUGCTT B | 3618 |
| R-008397711-000C | 1845 | 861 | CUUUGCGUGAGCAGGGUGC | GCACCCUGCUCACGCAAAGUU | 3619 |
| R-008397714-000D | 1408 | 862 | CUGUCUUUGGACUCUCAGG | CCUGAGAGUCCAAAGACAGUU | 3621 |
| R-008397714-000D | 1408 | 862 | CUGUCUUUGGACUCUCAGG | B CUGUCUUUGGACUCUCAGGTT B | 3620 |
| R-008397717-000E | 1059 | 863 | UACAUCAAGAAGGAGCUAA | B UACAUCAAGAAGGAGCUAATT B | 3622 |
| R-008397717-000E | 1059 | 863 | UACAUCAAGAAGGAGCUAA | UUAGCUCCUUCUUGAUGUAUU | 3623 |
| R-008397720-000L | 1381 | 864 | AGAUCCAAGUCAACGUCUU | AAGACGUUGACUUGGAUCUUU | 3625 |
| R-008397720-000L | 1381 | 864 | AGAUCCAAGUCAACGUCUU | B AGAUCCAAGUCAACGUCUUTT B | 3624 |
| R-008397723-000M | 1386 | 865 | CAAGUCAACGUCUUGUUCA | B CAAGUCAACGUCUUGUUCATT B | 3626 |
| R-008397723-000M | 1386 | 865 | CAAGUCAACGUCUUGUUCA | UGAACAAGACGUUGACUUGUU | 3627 |
| R-008397726-000N | 1470 | 866 | UCCUUGGGACUCUUGUUCA | UGAACAAGAGUCCCAAGGAUU | 3629 |
| R-008397726-000N | 1470 | 866 | UCCUUGGGACUCUUGUUCA | B UCCUUGGGACUCUUGUUCATT B | 3628 |
| R-008397729-000P | 1349 | 867 | GGUGGAAUGCAAGCUUUAG | CUAAAGCUUGCAUUCCACCUU | 3631 |
| R-008397729-000P | 1349 | 867 | GGUGGAAUGCAAGCUUUAG | B GGUGGAAUGCAAGCUUUAGTT B | 3630 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397732-000W | 1440 | 868 | CUGCAACUAAACAGGAAGG | CCUUCCUGUUUAGUUGCAGUU | 3633 |
| R-008397732-000W | 1440 | 868 | CUGCAACUAAACAGGAAGG | B CUGCAACUAAACAGGAAGGTT B | 3632 |
| R-008397735-000X | 1364 | 869 | UUAGGACUUCACCUGACAG | CUGUCAGGUGAAGUCCUAAUU | 3635 |
| R-008397735-000X | 1364 | 869 | UUAGGACUUCACCUGACAG | B UUAGGACUUCACCUGACAGTT B | 3634 |
| R-008397738-000Y | 502 | 870 | AGUAGCUGAUAUUGAUGGA | B AGUAGCUGAUAUUGAUGGATT B | 3636 |
| R-008397738-000Y | 502 | 870 | AGUAGCUGAUAUUGAUGGA | UCCAUCAAUAUCAGCUACUUU | 3637 |
| R-008397741-000E | 1246 | 871 | UAUAAUGAGGACCUAUACU | AGUAUAGGUCCUCAUUAUAUU | 3639 |
| R-008397741-000E | 1246 | 871 | UAUAAUGAGGACCUAUACU | B UAUAAUGAGGACCUAUACUTT B | 3638 |
| R-008397744-000F | 3178 | 872 | CCUGCUGUGAUACGAUGCU | AGCAUCGUAUCACAGCAGGUU | 3641 |
| R-008397744-000F | 3178 | 872 | CCUGCUGUGAUACGAUGCU | B CCUGCUGUGAUACGAUGCUTT B | 3640 |
| R-008397747-000G | 2483 | 873 | AUGGGUGGCCACCACCCUG | B AUGGGUGGCCACCACCCUGTT B | 3642 |
| R-008397747-000G | 2483 | 873 | AUGGGUGGCCACCACCCUG | CAGGGUGGUGGCCACCCAUUU | 3643 |
| R-008397750-000N | 1417 | 874 | GACUCUCAGGAAUCUUUCA | B GACUCUCAGGAAUCUUUCATT B | 3644 |
| R-008397750-000N | 1417 | 874 | GACUCUCAGGAAUCUUUCA | UGAAAGAUUCCUGAGAGUCUU | 3645 |
| R-008397753-000P | 1893 | 875 | GUGCACAUCAGGAUACCCA | B GUGCACAUCAGGAUACCCATT B | 3646 |
| R-008397753-000P | 1893 | 875 | GUGCACAUCAGGAUACCCA | UGGGUAUCCUGAUGUGCACUU | 3647 |
| R-008397756-000R | 817 | 876 | UUCCAGACACGCUAUCAUG | CAUGAUAGCGUGUCUGGAAUU | 3649 |
| R-008397756-000R | 817 | 876 | UUCCAGACACGCUAUCAUG | B UUCCAGACACGCUAUCAUGTT B | 3648 |
| R-008397759-000S | 711 | 877 | UUGCCACACGUGCAAUCCC | GGGAUUGCACGUGUGGCAAUU | 3651 |
| R-008397759-000S | 711 | 877 | UUGCCACACGUGCAAUCCC | B UUGCCACACGUGCAAUCCCTT B | 3650 |
| R-008397762-000Y | 1433 | 878 | UCAGAUGCUGCAACUAAAC | GUUUAGUUGCAGCAUCUGAUU | 3653 |
| R-008397762-000Y | 1433 | 878 | UCAGAUGCUGCAACUAAAC | B UCAGAUGCUGCAACUAAACTT B | 3652 |
| R-008397765-000Z | 1362 | 879 | CUUUAGGACUUCACCUGAC | GUCAGGUGAAGUCCUAAAGUU | 3655 |
| R-008397765-000Z | 1362 | 879 | CUUUAGGACUUCACCUGAC | B CUUUAGGACUUCACCUGACTT B | 3654 |
| R-008397768-000A | 1838 | 880 | CAUGCACCUUUGCGUGAGC | B CAUGCACCUUUGCGUGAGCTT B | 3656 |
| R-008397768-000A | 1838 | 880 | CAUGCACCUUUGCGUGAGC | GCUCACGCAAAGGUGCAUGUU | 3657 |
| R-008397771-000G | 1037 | 881 | ACAACUCUCCACAACCUUU | AAAGGUUGUGGAGAGUUGUUU | 3659 |
| R-008397771-000G | 1037 | 881 | ACAACUCUCCACAACCUUU | B ACAACUCUCCACAACCUUUTT B | 3658 |
| R-008397774-000H | 1474 | 882 | UGGGACUCUUGUUCAGCUU | B UGGGACUCUUGUUCAGCUUTT B | 3660 |
| R-008397774-000H | 1474 | 882 | UGGGACUCUUGUUCAGCUU | AAGCUGAACAAGAGUCCCAUU | 3661 |
| R-008397777-000J | 997 | 883 | GCUUGGUUCACCAGUGGAU | B GCUUGGUUCACCAGUGGAUTT B | 3662 |
| R-008397777-000J | 997 | 883 | GCUUGGUUCACCAGUGGAU | AUCCACUGGUGAACCAAGCUU | 3663 |
| R-008397780-000R | 931 | 884 | UUCCCAUCAUCGUGAGGGC | B UUCCCAUCAUCGUGAGGGCTT B | 3664 |
| R-008397780-000R | 931 | 884 | UUCCCAUCAUCGUGAGGGC | GCCCUCACGAUGAUGGGAAUU | 3665 |
| R-008397783-000S | 1313 | 885 | GUCUGCUCUAGUAAUAAGC | GCUUAUUACUAGAGCAGACUU | 3667 |
| R-008397783-000S | 1313 | 885 | GUCUGCUCUAGUAAUAAGC | B GUCUGCUCUAGUAAUAAGCTT B | 3666 |
| R-008397786-000T | 1487 | 886 | CAGCUUCUGGGUUCAGAUG | B CAGCUUCUGGGUUCAGAUGTT B | 3668 |
| R-008397786-000T | 1487 | 886 | CAGCUUCUGGGUUCAGAUG | CAUCUGAACCCAGAAGCUGUU | 3669 |
| R-008397789-000U | 1673 | 887 | CGUCAUCUGACCAGCCGAC | B CGUCAUCUGACCAGCCGACTT B | 3670 |
| R-008397789-000U | 1673 | 887 | CGUCAUCUGACCAGCCGAC | GUCGGCUGGUCAGAUGACUU | 3671 |
| R-008397792-000A | 561 | 888 | UGUUCCUGAGACAUUAGA | UCUAAUGUCUCAGGGAACAUU | 3673 |
| R-008397792-000A | 561 | 888 | UGUUCCUGAGACAUUAGA | B UGUUCCUGAGACAUUAGATT B | 3672 |
| R-008397795-000B | 1188 | 889 | GCAACCAAGAAAGCAAGCU | B GCAACCAAGAAAGCAAGCUTT B | 3674 |
| R-008397795-000B | 1188 | 889 | GCAACCAAGAAAGCAAGCU | AGCUUGCUUUCUUGGUUGCUU | 3675 |
| R-008397798-000C | 292 | 890 | GGAGUUGGACAUGGCCAUG | B GGAGUUGGACAUGGCCAUGTT B | 3676 |
| R-008397798-000C | 292 | 890 | GGAGUUGGACAUGGCCAUG | CAUGGCCAUGUCCAACUCCUU | 3677 |
| R-008397801-000V | 1958 | 891 | GUCCGCAUGGAAGAAAUAG | B GUCCGCAUGGAAGAAAUAGTT B | 3678 |
| R-008397801-000V | 1958 | 891 | GUCCGCAUGGAAGAAAUAG | CUAUUUCUUCCAUGCGGACUU | 3679 |
| R-008397804-000W | 2349 | 892 | CUGAUCUUGGACUUGAUAU | B CUGAUCUUGGACUUGAUAUTT B | 3680 |
| R-008397804-000W | 2349 | 892 | CUGAUCUUGGACUUGAUAU | AUAUCAAGUCCAAGAUCAGUU | 3681 |
| R-008397807-000X | 1460 | 893 | AUGGAAGGUCUCCUUGGGA | UCCCAAGGAGACCUUCCAUUU | 3683 |
| R-008397807-000X | 1460 | 893 | AUGGAAGGUCUCCUUGGGA | B AUGGAAGGUCUCCUUGGGATT B | 3682 |
| R-008397810-000D | 1576 | 894 | GAUGGUCUGCCAAGUGGGU | B GAUGGUCUGCCAAGUGGGUTT B | 3684 |
| R-008397810-000D | 1576 | 894 | GAUGGUCUGCCAAGUGGGU | ACCCACUUGGCAGACCAUCUU | 3685 |
| R-008397813-000E | 536 | 4 | CGAGCUCAGAGGGUACGAG | B CGAGCUCAGAGGGUACGAGTT B | 3686 |
| R-008397813-000E | 536 | 4 | CGAGCUCAGAGGGUACGAG | CUCGUACCCUCUGAGCUCGUU | 3687 |
| R-008397816-000F | 690 | 895 | ACUAUCAAGAUGAUGCAGA | UCUGCAUCAUCUUGAUAGUUU | 3689 |
| R-008397816-000F | 690 | 895 | ACUAUCAAGAUGAUGCAGA | B ACUAUCAAGAUGAUGCAGATT B | 3688 |
| R-008397819-000G | 655 | 896 | ACAGAUGCUGAAACAUGCA | B ACAGAUGCUGAAACAUGCATT B | 3690 |
| R-008397819-000G | 655 | 896 | ACAGAUGCUGAAACAUGCA | UGCAUGUUUCAGCAUCUGUUU | 3691 |
| R-008397822-000N | 2290 | 897 | UUCAGUUGAGCUGACCAGC | GCUGGUCAGCUCAACUGAAUU | 3693 |
| R-008397822-000N | 2290 | 897 | UUCAGUUGAGCUGACCAGC | B UUCAGUUGAGCUGACCAGCTT B | 3692 |
| R-008397825-000P | 1600 | 898 | AGAGGCUCUUGUGCGUACU | B AGAGGCUCUUGUGCGUACUTT B | 3694 |
| R-008397825-000P | 1600 | 898 | AGAGGCUCUUGUGCGUACU | AGUACGCACAAGAGCCUCUUU | 3695 |
| R-008397828-000R | 2432 | 899 | GGUGGAUAUGGCCAGGAUG | CAUCCUGGCCAUAUCCACCUU | 3697 |
| R-008397828-000R | 2432 | 899 | GGUGGAUAUGGCCAGGAUG | B GGUGGAUAUGGCCAGGAUGTT B | 3696 |
| R-008397831-000X | 710 | 900 | CUUGCCACACGUGCAAUCC | B CUUGCCACACGUGCAAUCCTT B | 3698 |
| R-008397831-000X | 710 | 900 | CUUGCCACACGUGCAAUCC | GGAUUGCACGUGUGGCAAGUU | 3699 |
| R-008397834-000Y | 1714 | 901 | GAAUGCAGUUCGCCUUCAC | B GAAUGCAGUUCGCCUUCACTT B | 3700 |
| R-008397834-000Y | 1714 | 901 | GAAUGCAGUUCGCCUUCAC | GUGAAGGCGAACUGCAUUCUU | 3701 |
| R-008397837-000Z | 2005 | 902 | CCUAGCUCGGGAUGUUCAC | B CCUAGCUCGGGAUGUUCACTT B | 3702 |
| R-008397837-000Z | 2005 | 902 | CCUAGCUCGGGAUGUUCAC | GUGAACAUCCCGAGCUAGGUU | 3703 |
| R-008397840-000F | 1728 | 903 | UUCACUAUGGACUACCAGU | B UUCACUAUGGACUACCAGUTT B | 3704 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397840-000F | 1728 | 903 | UUCACUAUGGACUACCAGU | ACUGGUAGUCCAUAGUGAAUU | 3705 |
| R-008397843-000G | 2482 | 904 | GAUGGGUGGCCACCACCCU | AGGGUGGUGGCCACCCAUCUU | 3707 |
| R-008397843-000G | 2482 | 904 | GAUGGGUGGCCACCACCCU | B GAUGGGUGGCCACCACCCUTT B | 3706 |
| R-008397846-000H | 768 | 905 | UGGUUAAUAAGGCUGCAGU | B UGGUUAAUAAGGCUGCAGUTT B | 3708 |
| R-008397846-000H | 768 | 905 | UGGUUAAUAAGGCUGCAGU | ACUGCAGCCUUAUUAACCAUU | 3709 |
| R-008397849-000J | 693 | 906 | AUCAAGAUGAUGCAGAACU | B AUCAAGAUGAUGCAGAACUTT B | 3710 |
| R-008397849-000J | 693 | 906 | AUCAAGAUGAUGCAGAACU | AGUUCUGCAUCAUCUUGAUUU | 3711 |
| R-008397852-000R | 3179 | 907 | CUGCUGUGAUACGAUGCUU | B CUGCUGUGAUACGAUGCUUTT B | 3712 |
| R-008397852-000R | 3179 | 907 | CUGCUGUGAUACGAUGCUU | AAGCAUCGUAUCACAGCAGUU | 3713 |
| R-008397855-000S | 1549 | 89 | CACUUGCAAUAAUUAUAAG | CUUAUAAUUAUUGCAAGUGUU | 3715 |
| R-008397855-000S | 1549 | 89 | CACUUGCAAUAAUUAUAAG | B CACUUGCAAUAAUUAUAAGTT B | 3714 |
| R-008397858-000T | 1792 | 167 | GGCUACUGUUGGAUUGAUU | AAUCAAUCCAACAGUAGCCUU | 3717 |
| R-008397858-000T | 1792 | 167 | GGCUACUGUUGGAUUGAUU | B GGCUACUGUUGGAUUGAUUTT B | 3716 |
| R-008397861-000Z | 2448 | 908 | AUGCCUUGGGUAUGGACCC | GGGUCCAUACCCAAGGCAUUU | 3719 |
| R-008397861-000Z | 2448 | 908 | AUGCCUUGGGUAUGGACCC | B AUGCCUUGGGUAUGGACCCTT B | 3718 |
| R-008397864-000A | 3183 | 909 | UGUGAUACGAUGCUUCAAG | B UGUGAUACGAUGCUUCAAGTT B | 3720 |
| R-008397864-000A | 3183 | 909 | UGUGAUACGAUGCUUCAAG | CUUGAAGCAUCGUAUCACAUU | 3721 |
| R-008397867-000B | 1293 | 910 | GAGUGCUGAAGGUGCUAUC | GAUAGCACCUUCAGCACUCUU | 3723 |
| R-008397867-000B | 1293 | 910 | GAGUGCUGAAGGUGCUAUC | B GAGUGCUGAAGGUGCUAUCTT B | 3722 |
| R-008397870-000H | 544 | 911 | GAGGGUACGAGCUGCUAUG | CAUAGCAGCUCGUACCCUCUU | 3725 |
| R-008397870-000H | 544 | 911 | GAGGGUACGAGCUGCUAUG | B GAGGGUACGAGCUGCUAUGTT B | 3724 |
| R-008397873-000J | 1676 | 26 | CAUCUGACCAGCCGACACC | GGUGUCGGCUGGUCAGAUGUU | 3727 |
| R-008397873-000J | 1676 | 26 | CAUCUGACCAGCCGACACC | B CAUCUGACCAGCCGACACCTT B | 3726 |
| R-008397876-000K | 2937 | 912 | UUAAUUGUAAUCUGAAUAA | B UUAAUUGUAAUCUGAAUAATT B | 3728 |
| R-008397876-000K | 2937 | 912 | UUAAUUGUAAUCUGAAUAA | UUAUUCAGAUUACAAUUAAUU | 3729 |
| R-008397879-000L | 1691 | 913 | CACCAAGAAGCAGAGAUGG | CCAUCUCUGCUUCUUGGUGUU | 3731 |
| R-008397879-000L | 1691 | 913 | CACCAAGAAGCAGAGAUGG | B CACCAAGAAGCAGAGAUGGTT B | 3730 |
| R-008397882-000T | 2195 | 120 | UUACUUCACUCUAGGAAUG | B UUACUUCACUCUAGGAAUGTT B | 3732 |
| R-008397882-000T | 2195 | 120 | UUACUUCACUCUAGGAAUG | CAUUCCUAGAGUGAAGUAAUU | 3733 |
| R-008397885-000U | 1356 | 186 | UGCAAGCUUUAGGACUUCA | B UGCAAGCUUUAGGACUUCATT B | 3734 |
| R-008397885-000U | 1356 | 186 | UGCAAGCUUUAGGACUUCA | UGAAGUCCUAAAGCUUGCAUU | 3735 |
| R-008397888-000V | 557 | 184 | GCUAUGUUCCCUGAGACAU | AUGUCUCAGGGAACAUAGCUU | 3737 |
| R-008397888-000V | 557 | 184 | GCUAUGUUCCCUGAGACAU | B GCUAUGUUCCCUGAGACAUTT B | 3736 |
| R-008397897-000D | 1353 | 914 | GAAUGCAAGCUUUAGGACU | AGUCCUAAAGCUUGCAUUCUU | 3739 |
| R-008397897-000D | 1353 | 914 | GAAUGCAAGCUUUAGGACU | B GAAUGCAAGCUUUAGGACUTT B | 3738 |
| R-008397900-000W | 1843 | 915 | ACCUUUGCGUGAGCAGGGU | B ACCUUUGCGUGAGCAGGGUTT B | 3740 |
| R-008397900-000W | 1843 | 915 | ACCUUUGCGUGAGCAGGGU | ACCCUGCUCACGCAAAGGUUU | 3741 |
| R-008397903-000X | 1302 | 916 | AGGUGCUAUCUGUCUGCUC | B AGGUGCUAUCUGUCUGCUCTT B | 3742 |
| R-008397903-000X | 1302 | 916 | AGGUGCUAUCUGUCUGCUC | GAGCAGACAGAUAGCACCUUU | 3743 |
| R-008397906-000Y | 2130 | 917 | UUGCUCAGGACAAGGAAGC | B UUGCUCAGGACAAGGAAGCTT B | 3744 |
| R-008397906-000Y | 2130 | 917 | UUGCUCAGGACAAGGAAGC | GCUUCCUUGUCCUGAGCAAUU | 3745 |
| R-008397909-000Z | 2165 | 918 | GCUGAGGGAGCCACAGCUC | B GCUGAGGGAGCCACAGCUCTT B | 3746 |
| R-008397909-000Z | 2165 | 918 | GCUGAGGGAGCCACAGCUC | GAGCUGUGGCUCCCUCAGCUU | 3747 |
| R-008397912-000F | 387 | 919 | CUACCACAGCUCCUUCUCU | B CUACCACAGCUCCUUCUCUTT B | 3748 |
| R-008397912-000F | 387 | 919 | CUACCACAGCUCCUUCUCU | AGAGAAGGAGCUGUGGUAGUU | 3749 |
| R-008397915-000G | 2472 | 920 | UGGAACAUGAGAUGGGUGG | CCACCCAUCUCAUGUUCCAUU | 3751 |
| R-008397915-000G | 2472 | 920 | UGGAACAUGAGAUGGGUGG | B UGGAACAUGAGAUGGGUGGTT B | 3750 |
| R-008397918-000H | 857 | 921 | GCUAUUGUACGUACCAUGC | B GCUAUUGUACGUACCAUGCTT B | 3752 |
| R-008397918-000H | 857 | 921 | GCUAUUGUACGUACCAUGC | GCAUGGUACGUACAAUAGCUU | 3753 |
| R-008397921-000P | 1816 | 922 | UCUUGCCCUUUGUCCCGCA | UGCGGGACAAAGGGCAAGAUU | 3755 |
| R-008397921-000P | 1816 | 922 | UCUUGCCCUUUGUCCCGCA | B UCUUGCCCUUUGUCCCGCATT B | 3754 |
| R-008397924-000R | 1561 | 923 | UUAUAAGAACAAGAUGAUG | CAUCAUCUUGUUCUUAUAAUU | 3757 |
| R-008397924-000R | 1561 | 923 | UUAUAAGAACAAGAUGAUG | B UUAUAAGAACAAGAUGAUGTT B | 3756 |
| R-008397927-000S | 811 | 924 | GGAAGCUUCCAGACACGCU | B GGAAGCUUCCAGACACGCUTT B | 3758 |
| R-008397927-000S | 811 | 924 | GGAAGCUUCCAGACACGCU | AGCGUGUCUGGAAGCUUCCUU | 3759 |
| R-008397930-000Y | 1327 | 925 | UAAGCCGGCUAUUGUAGAA | B UAAGCCGGCUAUUGUAGAATT B | 3760 |
| R-008397930-000Y | 1327 | 925 | UAAGCCGGCUAUUGUAGAA | UUCUACAAUAGCCGGCUUAUU | 3761 |
| R-008397933-000Z | 757 | 926 | GGACCAGGUGGUGGUUAAU | B GGACCAGGUGGUGGUUAAUTT B | 3762 |
| R-008397933-000Z | 757 | 926 | GGACCAGGUGGUGGUUAAU | AUUAACCACCACCUGGUCCUU | 3763 |
| R-008397936-000A | 507 | 927 | CUGAUAUUGAUGGACAGUA | B CUGAUAUUGAUGGACAGUATT B | 3764 |
| R-008397936-000A | 507 | 927 | CUGAUAUUGAUGGACAGUA | UACUGUCCAUCAAUAUCAGUU | 3765 |
| R-008397939-000B | 3092 | 928 | UGGGUAGGGUAAAUCAGUA | B UGGGUAGGGUAAAUCAGUATT B | 3766 |
| R-008397939-000B | 3092 | 928 | UGGGUAGGGUAAAUCAGUA | UACUGAUUUACCCUACCCAUU | 3767 |
| R-008397942-000H | 2359 | 929 | ACUUGAUAUUGGUGCCCAG | B ACUUGAUAUUGGUGCCCAGTT B | 3768 |
| R-008397942-000H | 2359 | 929 | ACUUGAUAUUGGUGCCCAG | CUGGGCACCAAUAUCAAGUUU | 3769 |
| R-008397945-000J | 1753 | 930 | UAAGCUCUUACACCCACCA | B UAAGCUCUUACACCCACCATT B | 3770 |
| R-008397945-000J | 1753 | 930 | UAAGCUCUUACACCCACCA | UGGUGGGUGUAAGAGCUUAUU | 3771 |
| R-008397948-000K | 273 | 931 | CUACUCAAGCUGAUUUGAU | AUCAAAUCAGCUUGAGUAGUU | 3773 |
| R-008397948-000K | 273 | 931 | CUACUCAAGCUGAUUUGAU | B CUACUCAAGCUGAUUUGAUTT B | 3772 |
| R-008397951-000S | 1859 | 932 | GGUGCCAUCCACGACUAG | CUAGUCGUGGAAUGGCACCUU | 3775 |
| R-008397951-000S | 1859 | 932 | GGUGCCAUCCACGACUAG | B GGUGCCAUCCACGACUAGTT B | 3774 |
| R-008397954-000T | 296 | 933 | UUGGACAUGGCCAUGGAAC | B UUGGACAUGGCCAUGGAACTT B | 3776 |
| R-008397954-000T | 296 | 933 | UUGGACAUGGCCAUGGAAC | GUUCCAUGGCCAUGUCCAAUU | 3777 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008397957-000U | 615 | 934 | CUGCUCAUCCCACUAAUGU | ACAUUAGUGGGAUGAGCAGUU | 3779 |
| R-008397957-000U | 615 | 934 | CUGCUCAUCCCACUAAUGU | B CUGCUCAUCCCACUAAUGUTT B | 3778 |
| R-008397960-000A | 301 | 935 | CAUGGCCAUGGAACCAGAC | GUCUGGUUCCAUGGCCAUGUU | 3781 |
| R-008397960-000A | 301 | 935 | CAUGGCCAUGGAACCAGAC | B CAUGGCCAUGGAACCAGACTT B | 3780 |
| R-008397963-000B | 1184 | 936 | UAUGGCAACCAAGAAAGCA | B UAUGGCAACCAAGAAAGCATT B | 3782 |
| R-008397963-000B | 1184 | 936 | UAUGGCAACCAAGAAAGCA | UGCUUUCUUGGUUGCCAUAUU | 3783 |
| R-008397966-000C | 1006 | 937 | ACCAGUGGAUUCUGUGUUG | B ACCAGUGGAUUCUGUGUUGTT B | 3784 |
| R-008397966-000C | 1006 | 937 | ACCAGUGGAUUCUGUGUUG | CAACACAGAAUCCACUGGUUU | 3785 |
| R-008397969-000D | 2189 | 938 | ACAGAGUUACUUCACUCUA | B ACAGAGUUACUUCACUCUATT B | 3786 |
| R-008397969-000D | 2189 | 938 | ACAGAGUUACUUCACUCUA | UAGAGUGAAGUAACUCUGUUU | 3787 |
| R-008397972-000K | 1365 | 939 | UAGGACUUCACCUGACAGA | UCUGUCAGGUGAAGUCCUAUU | 3789 |
| R-008397972-000K | 1365 | 939 | UAGGACUUCACCUGACAGA | B UAGGACUUCACCUGACAGATT B | 3788 |
| R-008397975-000L | 2442 | 940 | GCCAGGAUGCCUUGGGUAU | B GCCAGGAUGCCUUGGGUAUTT B | 3790 |
| R-008397975-000L | 2442 | 940 | GCCAGGAUGCCUUGGGUAU | AUACCCAAGGCAUCCUGGCUU | 3791 |
| R-008397978-000M | 1249 | 941 | AAUGAGGACCUAUACUUAC | B AAUGAGGACCUAUACUUACTT B | 3792 |
| R-008397978-000M | 1249 | 941 | AAUGAGGACCUAUACUUAC | GUAAGUAUAGGUCCUCAUUUU | 3793 |
| R-008397981-000U | 1144 | 942 | AUUCUUGGCUAUUACGACA | B AUUCUUGGCUAUUACGACATT B | 3794 |
| R-008397981-000U | 1144 | 942 | AUUCUUGGCUAUUACGACA | UGUCGUAAUAGCCAAGAAUUU | 3795 |
| R-008397984-000V | 2075 | 943 | CUUUAUUCUCCCAUUGAAA | B CUUUAUUCUCCCAUUGAAATT B | 3796 |
| R-008397984-000V | 2075 | 943 | CUUUAUUCUCCCAUUGAAA | UUUCAAUGGGAGAAUAAAGUU | 3797 |
| R-008397987-000W | 759 | 94 | ACCAGGUGGUGGUUAAUAA | B ACCAGGUGGUGGUUAAUAATT B | 3798 |
| R-008397987-000W | 759 | 94 | ACCAGGUGGUGGUUAAUAA | UUAUUAACCACCACCUGGUUU | 3799 |
| R-008397990-000C | 1545 | 44 | ACCUCACUUGCAAUAAUUA | B ACCUCACUUGCAAUAAUUATT B | 3800 |
| R-008397990-000C | 1545 | 44 | ACCUCACUUGCAAUAAUUA | UAAUUAUUGCAAGUGAGGUUU | 3801 |
| R-008397993-000D | 504 | 944 | UAGCUGAUAUUGAUGGACA | UGUCCAUCAAUAUCAGCUAUU | 3803 |
| R-008397993-000D | 504 | 944 | UAGCUGAUAUUGAUGGACA | B UAGCUGAUAUUGAUGGACATT B | 3802 |
| R-008397996-000E | 1405 | 945 | GAACUGUCUUUGGACUCUC | B GAACUGUCUUUGGACUCUCTT B | 3804 |
| R-008397996-000E | 1405 | 945 | GAACUGUCUUUGGACUCUC | GAGAGUCCAAAGACAGUUCUU | 3805 |
| R-008397999-000F | 333 | 946 | UUAGUCACUGGCAGCAACA | UGUUGCUGCCAGUGACUAAUU | 3807 |
| R-008397999-000F | 333 | 946 | UUAGUCACUGGCAGCAACA | B UUAGUCACUGGCAGCAACATT B | 3806 |
| R-008398002-000V | 1032 | 947 | CCAUUACAACUCUCCACAA | B CCAUUACAACUCUCCACAATT B | 3808 |
| R-008398002-000V | 1032 | 947 | CCAUUACAACUCUCCACAA | UUGUGGAGAGUUGUAAUGGUU | 3809 |
| R-008398005-000W | 1748 | 948 | GUGGUUAAGCUCUUACACC | B GUGGUUAAGCUCUUACACCTT B | 3810 |
| R-008398005-000W | 1748 | 948 | GUGGUUAAGCUCUUACACC | GGUGUAAGAGCUUAACCACUU | 3811 |
| R-008398008-000X | 283 | 949 | UGAUUUGAUGGAGUUGGAC | GUCCAACUCCAUCAAAUCAUU | 3813 |
| R-008398008-000X | 283 | 949 | UGAUUUGAUGGAGUUGGAC | B UGAUUUGAUGGAGUUGGACTT B | 3812 |
| R-008398011-000D | 1700 | 950 | GCAGAGAUGGCCCAGAAUG | B GCAGAGAUGGCCCAGAAUGTT B | 3814 |
| R-008398011-000D | 1700 | 950 | GCAGAGAUGGCCCAGAAUG | CAUUCUGGGCCAUCUCUGCUU | 3815 |
| R-008398014-000E | 1445 | 951 | ACUAAACAGGAAGGGAUGG | B ACUAAACAGGAAGGGAUGGTT B | 3816 |
| R-008398014-000E | 1445 | 951 | ACUAAACAGGAAGGGAUGG | CCAUCCCUUCCUGUUUAGUUU | 3817 |
| R-008398017-000F | 1133 | 952 | ACAAAUGUUAAAUUCUUGG | CCAAGAAUUUAACAUUUGUUU | 3819 |
| R-008398017-000F | 1133 | 952 | ACAAAUGUUAAAUUCUUGG | B ACAAAUGUUAAAUUCUUGGTT B | 3818 |
| R-008398020-000M | 527 | 953 | GCAAUGACUCGAGCUCAGA | UCUGAGCUCGAGUCAUUGCUU | 3821 |
| R-008398020-000M | 527 | 953 | GCAAUGACUCGAGCUCAGA | B GCAAUGACUCGAGCUCAGATT B | 3820 |
| R-008398023-000N | 2010 | 954 | CUCGGGAUGUUCACAACCG | CGGUUGUGAACAUCCCGAGUU | 3823 |
| R-008398023-000N | 2010 | 954 | CUCGGGAUGUUCACAACCG | B CUCGGGAUGUUCACAACCGTT B | 3822 |
| R-008398026-000P | 851 | 955 | GUGUCUGCUAUUGUACGUA | UACGUACAAUAGCAGACACUU | 3825 |
| R-008398026-000P | 851 | 955 | GUGUCUGCUAUUGUACGUA | B GUGUCUGCUAUUGUACGUATT B | 3824 |
| R-008398029-000R | 436 | 956 | UGUGGAUACCUCCCAAGUC | B UGUGGAUACCUCCCAAGUCTT B | 3826 |
| R-008398029-000R | 436 | 956 | UGUGGAUACCUCCCAAGUC | GACUUGGGAGGUAUCCACAUU | 3827 |
| R-008398032-000X | 1601 | 2 | GAGGCUCUUGUGCGUACUG | B GAGGCUCUUGUGCGUACUGTT B | 3828 |
| R-008398032-000X | 1601 | 2 | GAGGCUCUUGUGCGUACUG | CAGUACGCACAAGAGCCUCUU | 3829 |
| R-008398035-000Y | 2446 | 957 | GGAUGCCUUGGGUAUGGAC | B GGAUGCCUUGGGUAUGGACTT B | 3830 |
| R-008398035-000Y | 2446 | 957 | GGAUGCCUUGGGUAUGGAC | GUCCAUACCCAAGGCAUCCUU | 3831 |
| R-008398038-000Z | 1142 | 958 | AAAUUCUUGGCUAUUACGA | B AAAUUCUUGGCUAUUACGATT B | 3832 |
| R-008398038-000Z | 1142 | 958 | AAAUUCUUGGCUAUUACGA | UCGUAAUAGCCAAGAAUUUUU | 3833 |
| R-008398041-000F | 549 | 959 | UACGAGCUGCUAUGUUCCC | B UACGAGCUGCUAUGUUCCCTT B | 3834 |
| R-008398041-000F | 549 | 959 | UACGAGCUGCUAUGUUCCC | GGGAACAUAGCAGCUCGUAUU | 3835 |
| R-008398044-000G | 1083 | 960 | CAGUGCGUUUAGCUGGUGG | CCACCAGCUAAACGCACUGUU | 3837 |
| R-008398044-000G | 1083 | 960 | CAGUGCGUUUAGCUGGUGG | B CAGUGCGUUUAGCUGGUGGTT B | 3836 |
| R-008398047-000H | 695 | 961 | CAAGAUGAUGCAGAACUUG | CAAGUUCUGCAUCAUCUUGUU | 3839 |
| R-008398047-000H | 695 | 961 | CAAGAUGAUGCAGAACUUG | B CAAGAUGAUGCAGAACUUGTT B | 3838 |
| R-008398050-000P | 885 | 962 | AUGAUGUAGAAACAGCUCG | B AUGAUGUAGAAACAGCUCGTT B | 3840 |
| R-008398050-000P | 885 | 962 | AUGAUGUAGAAACAGCUCG | CGAGCUGUUUCUACAUCAUUU | 3841 |
| R-008398056-000S | 2067 | 963 | UGCAGCUGCUUUAUUCUCC | B UGCAGCUGCUUUAUUCUCCTT B | 3842 |
| R-008398056-000S | 2067 | 963 | UGCAGCUGCUUUAUUCUCC | GGAGAAUAAAGCAGCUGCAUU | 3843 |
| R-008398059-000T | 390 | 964 | CCACAGCUCCUUCUCUGAG | CUCAGAGAAGGAGCUGUGGUU | 3845 |
| R-008398059-000T | 390 | 964 | CCACAGCUCCUUCUCUGAG | B CCACAGCUCCUUCUCUGAGTT B | 3844 |
| R-008398062-000Z | 1719 | 965 | CAGUUCGCCUUCACUAUGG | B CAGUUCGCCUUCACUAUGGTT B | 3846 |
| R-008398062-000Z | 1719 | 965 | CAGUUCGCCUUCACUAUGG | CCAUAGUGAAGGCGAACUGUU | 3847 |
| R-008398065-000A | 813 | 966 | AAGCUUCCAGACACGCUAU | AUAGCGUGUCUGGAAGCUUUU | 3849 |
| R-008398065-000A | 813 | 966 | AAGCUUCCAGACACGCUAU | B AAGCUUCCAGACACGCUAUTT B | 3848 |
| R-008398068-000B | 2289 | 967 | UUUCAGUUGAGCUGACCAG | B UUUCAGUUGAGCUGACCAGTT B | 3850 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398068-000B | 2289 | 967 | UUUCAGUUGAGCUGACCAG | CUGGUCAGCUCAACUGAAAUU | 3851 |
| R-008398071-000H | 377 | 968 | UCUGGUGCCACUACCACAG | B UCUGGUGCCACUACCACAGTT B | 3852 |
| R-008398071-000H | 377 | 968 | UCUGGUGCCACUACCACAG | CUGUGGUAGUGGCACCAGAUU | 3853 |
| R-008398074-000J | 826 | 969 | CGCUAUCAUGCGUUCUCCU | AGGAGAACGCAUGAUAGCGUU | 3855 |
| R-008398074-000J | 826 | 969 | CGCUAUCAUGCGUUCUCCU | B CGCUAUCAUGCGUUCUCCUTT B | 3854 |
| R-008398077-000K | 1634 | 970 | GACAGGGAAGACAUCACUG | CAGUGAUGUCUUCCCUGUCUU | 3857 |
| R-008398077-000K | 1634 | 970 | GACAGGGAAGACAUCACUG | B GACAGGGAAGACAUCACUGTT B | 3856 |
| R-008398080-000S | 1208 | 971 | AUCAUACUGGCUAGUGGUG | B AUCAUACUGGCUAGUGGUGTT B | 3858 |
| R-008398080-000S | 1208 | 971 | AUCAUACUGGCUAGUGGUG | CACCACUAGCCAGUAUGAUUU | 3859 |
| R-008398083-000T | 1628 | 972 | GCUGGUGACAGGGAAGACA | UGUCUUCCCUGUCACCAGCUU | 3861 |
| R-008398083-000T | 1628 | 972 | GCUGGUGACAGGGAAGACA | B GCUGGUGACAGGGAAGACATTB | 3860 |
| R-008398086-000U | 2003 | 973 | AUCCUAGCUCGGGAUGUUC | GAACAUCCCGAGCUAGGAUUU | 3863 |
| R-008398086-000U | 2003 | 973 | AUCCUAGCUCGGGAUGUUC | B AUCCUAGCUCGGGAUGUUCTT B | 3862 |
| R-008398089-000V | 452 | 974 | GUCCUGUAUGAGUGGGAAC | B GUCCUGUAUGAGUGGGAACTT B | 3864 |
| R-008398089-000V | 452 | 974 | GUCCUGUAUGAGUGGGAAC | GUUCCCACUCAUACAGGACUU | 3865 |
| R-008398092-000B | 2543 | 175 | GCCCAGGACCUCAUGGAUG | CAUCCAUGAGGUCCUGGGCUU | 3867 |
| R-008398092-000B | 2543 | 175 | GCCCAGGACCUCAUGGAUG | B GCCCAGGACCUCAUGGAUGTT B | 3866 |
| R-008398095-000C | 3081 | 975 | UGGGAUAUGUAUGGGUAGG | CCUACCCAUACAUAUCCCAUU | 3869 |
| R-008398095-000C | 3081 | 975 | UGGGAUAUGUAUGGGUAGG | B UGGGAUAUGUAUGGGUAGGTT B | 3868 |
| R-008398098-000D | 2354 | 976 | CUUGGACUUGAUAUUGGUG | B CUUGGACUUGAUAUUGGUGTT B | 3870 |
| R-008398098-000D | 2354 | 976 | CUUGGACUUGAUAUUGGUG | CACCAAUAUCAAGUCCAAGUU | 3871 |
| R-008398101-000W | 1822 | 977 | CCUUUGUCCCGCAAAUCAU | B CCUUUGUCCCGCAAAUCAUTT B | 3872 |
| R-008398101-000W | 1822 | 977 | CCUUUGUCCCGCAAAUCAU | AUGAUUUGCGGGACAAAGGUU | 3873 |
| R-008398107-000Y | 1299 | 978 | UGAAGGUGCUAUCUGUCUG | CAGACAGAUAGCACCUUCAUU | 3875 |
| R-008398107-000Y | 1299 | 978 | UGAAGGUGCUAUCUGUCUG | B UGAAGGUGCUAUCUGUCUGTT B | 3874 |
| R-008398110-000E | 486 | 979 | CCUUCACUCAAGAACAAGU | B CCUUCACUCAAGAACAAGUTT B | 3876 |
| R-008398110-000E | 486 | 979 | CCUUCACUCAAGAACAAGU | ACUUGUUCUUGAGUGAAGGUU | 3877 |
| R-008398116-000G | 1463 | 980 | GAAGGUCUCCUUGGGACUC | B GAAGGUCUCCUUGGGACUCTT B | 3878 |
| R-008398116-000G | 1463 | 980 | GAAGGUCUCCUUGGGACUC | GAGUCCCAAGGAGACCUUCUU | 3879 |
| R-008398119-000H | 2280 | 981 | AGAAACGGCUUUCAGUUGA | B AGAAACGGCUUUCAGUUGATT B | 3880 |
| R-008398119-000H | 2280 | 981 | AGAAACGGCUUUCAGUUGA | UCAACUGAAAGCCGUUUCUUU | 3881 |
| R-008398122-000P | 1907 | 982 | ACCCAGCGCCGUACGUCCA | B ACCCAGCGCCGUACGUCCATT B | 3882 |
| R-008398122-000P | 1907 | 982 | ACCCAGCGCCGUACGUCCA | UGGACGUACGGCGCUGGGUUU | 3883 |
| R-008398125-000R | 923 | 983 | CAUAACCUUUCCCAUCAUC | B CAUAACCUUUCCCAUCAUCTT B | 3884 |
| R-008398125-000R | 923 | 983 | CAUAACCUUUCCCAUCAUC | GAUGAUGGGAAAGGUUAUGUU | 3885 |
| R-008398128-000S | 1979 | 984 | GAAGGUUGUACCGGAGCCC | B GAAGGUUGUACCGGAGCCCTT B | 3886 |
| R-008398128-000S | 1979 | 984 | GAAGGUUGUACCGGAGCCC | GGGCUCCGGUACAACCUUCUU | 3887 |
| R-008398131-000Y | 1827 | 985 | GUCCCGCAAAUCAUGCACC | B GUCCCGCAAAUCAUGCACCTT B | 3888 |
| R-008398131-000Y | 1827 | 985 | GUCCCGCAAAUCAUGCACC | GGUGCAUGAUUUGCGGGACUU | 3889 |
| R-008398134-000Z | 1201 | 986 | CAAGCUCAUCAUACUGGCU | AGCCAGUAUGAUGAGCUUGUU | 3891 |
| R-008398134-000Z | 1201 | 986 | CAAGCUCAUCAUACUGGCU | B CAAGCUCAUCAUACUGGCUTT B | 3890 |
| R-008398137-000A | 1913 | 987 | CGCCGUACGUCCAUGGGUG | B CGCCGUACGUCCAUGGGUGTT B | 3892 |
| R-008398137-000A | 1913 | 987 | CGCCGUACGUCCAUGGGUG | CACCCAUGGACGUACGGCGUU | 3893 |
| R-008398140-000G | 2191 | 988 | AGAGUUACUUCACUCUAGG | CCUAGAGUGAAGUAACUCUUU | 3895 |
| R-008398140-000G | 2191 | 988 | AGAGUUACUUCACUCUAGG | B AGAGUUACUUCACUCUAGGTT B | 3894 |
| R-008398143-000H | 295 | 989 | GUUGGACAUGGCCAUGGAA | UUCCAUGGCCAUGUCCAACUU | 3897 |
| R-008398143-000H | 295 | 989 | GUUGGACAUGGCCAUGGAA | B GUUGGACAUGGCCAUGGAATT B | 3896 |
| R-008398146-000J | 1149 | 990 | UGGCUAUUACGACAGACUG | B UGGCUAUUACGACAGACUGTT B | 3898 |
| R-008398146-000J | 1149 | 990 | UGGCUAUUACGACAGACUG | CAGUCUGUCGUAAUAGCCAUU | 3899 |
| R-008398149-000K | 533 | 991 | ACUCGAGCUCAGAGGGUAC | B ACUCGAGCUCAGAGGGUACTT B | 3900 |
| R-008398149-000K | 533 | 991 | ACUCGAGCUCAGAGGGUAC | GUACCCUCUGAGCUCGAGUUU | 3901 |
| R-008398152-000S | 604 | 992 | ACAGUUUGAUGCUGCUCAU | B ACAGUUUGAUGCUGCUCAUTT B | 3902 |
| R-008398152-000S | 604 | 992 | ACAGUUUGAUGCUGCUCAU | AUGAGCAGCAUCAAACUGUUU | 3903 |
| R-008398155-000T | 766 | 993 | GGUGGUUAAUAAGGCUGCA | B GGUGGUUAAUAAGGCUGCATT B | 3904 |
| R-008398155-000T | 766 | 993 | GGUGGUUAAUAAGGCUGCA | UGCAGCCUUAUUAACCACCUU | 3905 |
| R-008398158-000U | 1823 | 994 | CUUUGUCCCGCAAAUCAUG | B CUUUGUCCCGCAAAUCAUGTT B | 3906 |
| R-008398158-000U | 1823 | 994 | CUUUGUCCCGCAAAUCAUG | CAUGAUUUGCGGGACAAAGUU | 3907 |
| R-008398161-000A | 2048 | 995 | AAUACCAUUCCAUUGUUUG | CAAACAAUGGAAUGGUAUUUU | 3909 |
| R-008398161-000A | 2048 | 995 | AAUACCAUUCCAUUGUUUG | B AAUACCAUUCCAUUGUUUGTT B | 3908 |
| R-008398164-000B | 714 | 996 | CCACACGUGCAAUCCCUGA | B CCACACGUGCAAUCCCUGATT B | 3910 |
| R-008398164-000B | 714 | 996 | CCACACGUGCAAUCCCUGA | UCAGGGAUUGCACGUGUGGUU | 3911 |
| R-008398167-000C | 2439 | 997 | AUGGCCAGGAUGCCUUGGG | CCCAAGGCAUCCUGGCCAUUU | 3913 |
| R-008398167-000C | 2439 | 997 | AUGGCCAGGAUGCCUUGGG | B AUGGCCAGGAUGCCUUGGGTT B | 3912 |
| R-008398170-000J | 1903 | 998 | GGAUACCCAGCGCCGUACG | B GGAUACCCAGCGCCGUACGTT B | 3914 |
| R-008398170-000J | 1903 | 998 | GGAUACCCAGCGCCGUACG | CGUACGGCGCUGGGUAUCCUU | 3915 |
| R-008398173-000K | 2395 | 999 | UCGCCAGGAUGAUCCUAGC | GCUAGGAUCAUCCUGGCGAUU | 3917 |
| R-008398173-000K | 2395 | 999 | UCGCCAGGAUGAUCCUAGC | B UCGCCAGGAUGAUCCUAGCTT B | 3916 |
| R-008398176-000L | 789 | 1000 | UGGUCCAUCAGCUUUCUAA | UUAGAAAGCUGAUGGACCAUU | 3919 |
| R-008398176-000L | 789 | 1000 | UGGUCCAUCAGCUUUCUAA | B UGGUCCAUCAGCUUUCUAATT B | 3918 |
| R-008398179-000M | 3085 | 1001 | AUAUGUAUGGGUAGGGUAA | UUACCCUACCCAUACAUAUUU | 3921 |
| R-008398179-000M | 3085 | 1001 | AUAUGUAUGGGUAGGGUAA | B AUAUGUAUGGGUAGGGUAATT B | 3920 |
| R-008398182-000U | 1710 | 1002 | CCCAGAAUGCAGUUCGCCU | B CCCAGAAUGCAGUUCGCCUTT B | 3922 |
| R-008398182-000U | 1710 | 1002 | CCCAGAAUGCAGUUCGCCU | AGGCGAACUGCAUUCUGGGUU | 3923 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398185-000V | 1336 | 1003 | UAUUGUAGAAGCUGGUGGA | B UAUUGUAGAAGCUGGUGGATT B | 3924 |
| R-008398185-000V | 1336 | 1003 | UAUUGUAGAAGCUGGUGGA | UCCACCAGCUUCUACAAUAUU | 3925 |
| R-008398188-000W | 3089 | 1004 | GUAUGGGUAGGGUAAAUCA | UGAUUUACCCUACCCAUACUU | 3927 |
| R-008398188-000W | 3089 | 1004 | GUAUGGGUAGGGUAAAUCA | B GUAUGGGUAGGGUAAAUCATT B | 3926 |
| R-008398191-000C | 2351 | 1005 | GAUCUUGGACUUGAUAUUG | B GAUCUUGGACUUGAUAUUGTT B | 3928 |
| R-008398191-000C | 2351 | 1005 | GAUCUUGGACUUGAUAUUG | CAAUAUCAAGUCCAAGAUCUU | 3929 |
| R-008398194-000D | 716 | 1006 | ACACGUGCAAUCCCUGAAC | B ACACGUGCAAUCCCUGAACTT B | 3930 |
| R-008398194-000D | 716 | 1006 | ACACGUGCAAUCCCUGAAC | GUUCAGGGAUUGCACGUGUUU | 3931 |
| R-008398197-000E | 1911 | 1007 | AGCGCCGUACGUCCAUGGG | B AGCGCCGUACGUCCAUGGGTT B | 3932 |
| R-008398197-000E | 1911 | 1007 | AGCGCCGUACGUCCAUGGG | CCCAUGGACGUACGGCGCUUU | 3933 |
| R-008398200-000X | 1985 | 1008 | UGUACCGGAGCCCUUCACA | UGUGAAGGGCUCCGGUACAUU | 3935 |
| R-008398200-000X | 1985 | 1008 | UGUACCGGAGCCCUUCACA | B UGUACCGGAGCCCUUCACATT B | 3934 |
| R-008398203-000Y | 2516 | 1009 | GUUGAUGGGCUGCCAGAUC | B GUUGAUGGGCUGCCAGAUCTT B | 3936 |
| R-008398203-000Y | 2516 | 1009 | GUUGAUGGGCUGCCAGAUC | GAUCUGGCAGCCCAUCAACUU | 3937 |
| R-008398206-000Z | 1762 | 1010 | ACACCCACCAUCCCACUGG | CCAGUGGGAUGGUGGGUGUUU | 3939 |
| R-008398206-000Z | 1762 | 1010 | ACACCCACCAUCCCACUGG | B ACACCCACCAUCCCACUGGTT B | 3938 |
| R-008398209-000A | 1156 | 1011 | UACGACAGACUGCCUUCAA | B UACGACAGACUGCCUUCAATT B | 3940 |
| R-008398209-000A | 1156 | 1011 | UACGACAGACUGCCUUCAA | UUGAAGGCAGUCUGUCGUAUU | 3941 |
| R-008398212-000G | 1887 | 1012 | UUGUUCGUGCACAUCAGGA | B UUGUUCGUGCACAUCAGGATT B | 3942 |
| R-008398212-000G | 1887 | 1012 | UUGUUCGUGCACAUCAGGA | UCCUGAUGUGCACGAACAAUU | 3943 |
| R-008398215-000H | 1833 | 1013 | CAAAUCAUGCACCUUUGCG | CGCAAAGGUGCAUGAUUUGUU | 3945 |
| R-008398215-000H | 1833 | 1013 | CAAAUCAUGCACCUUUGCG | B CAAAUCAUGCACCUUUGCGTT B | 3944 |
| R-008398218-000J | 967 | 1014 | GUCUGGAGGCAUUCCUGCC | GGCAGGAAUGCCUCCAGACUU | 3947 |
| R-008398218-000J | 967 | 1014 | GUCUGGAGGCAUUCCUGCC | B GUCUGGAGGCAUUCCUGCCTT B | 3946 |
| R-008398221-000R | 1730 | 1015 | CACUAUGGACUACCAGUUG | CAACUGGUAGUCCAUAGUGUU | 3949 |
| R-008398221-000R | 1730 | 1015 | CACUAUGGACUACCAGUUG | B CACUAUGGACUACCAGUUGTT B | 3948 |
| R-008398224-000S | 829 | 1016 | UAUCAUGCGUUCUCCUCAG | CUGAGGAGAACGCAUGAUAUU | 3951 |
| R-008398224-000S | 829 | 1016 | UAUCAUGCGUUCUCCUCAG | B UAUCAUGCGUUCUCCUCAGTT B | 3950 |
| R-008398227-000T | 890 | 1017 | GUAGAAACAGCUCGUUGUA | B GUAGAAACAGCUCGUUGUATT B | 3952 |
| R-008398227-000T | 890 | 1017 | GUAGAAACAGCUCGUUGUA | UACAACGAGCUGUUUCUACUU | 3953 |
| R-008398230-000Z | 2181 | 1018 | CUCCUCUGACAGAGUUACU | AGUAACUCUGUCAGAGGAGUU | 3955 |
| R-008398230-000Z | 2181 | 1018 | CUCCUCUGACAGAGUUACU | B CUCCUCUGACAGAGUUACUTT B | 3954 |
| R-008398233-000A | 2131 | 1019 | UGCUCAGGACAAGGAAGCU | B UGCUCAGGACAAGGAAGCUTT B | 3956 |
| R-008398233-000A | 2131 | 1019 | UGCUCAGGACAAGGAAGCU | AGCUUCCUUGUCCUGAGCAUU | 3957 |
| R-008398236-000B | 1586 | 1020 | CAAGUGGUGGUAUAGAGG | B CAAGUGGUGGUAUAGAGGTT B | 3958 |
| R-008398236-000B | 1586 | 1020 | CAAGUGGUGGUAUAGAGG | C CUCUAUACCACCCACUUGUU | 3959 |
| R-008398239-000C | 765 | 1021 | UGGUGGUUAAUAAGGCUGC | B UGGUGGUUAAUAAGGCUGCTT B | 3960 |
| R-008398239-000C | 765 | 1021 | UGGUGGUUAAUAAGGCUGC | GCAGCCUUAUUAACCACCAUU | 3961 |
| R-008398242-000J | 1369 | 1022 | ACUUCACCUGACAGAUCCA | B ACUUCACCUGACAGAUCCATT B | 3962 |
| R-008398242-000J | 1369 | 1022 | ACUUCACCUGACAGAUCCA | UGGAUCUGUCAGGUGAAGUUU | 3963 |
| R-008398245-000K | 1724 | 1023 | CGCCUUCACUAUGGACUAC | GUAGUCCAUAGUGAAGGCGUU | 3965 |
| R-008398245-000K | 1724 | 1023 | CGCCUUCACUAUGGACUAC | B CGCCUUCACUAUGGACUACTT B | 3964 |
| R-008398248-000L | 834 | 1024 | UGCGUUCUCCUCAGAUGGU | ACCAUCUGAGGAGAACGCAUU | 3967 |
| R-008398248-000L | 834 | 1024 | UGCGUUCUCCUCAGAUGGU | B UGCGUUCUCCUCAGAUGGUTT B | 3966 |
| R-008398251-000T | 1983 | 1025 | GUUGUACCGGAGCCCUUCA | B GUUGUACCGGAGCCCUUCATT B | 3968 |
| R-008398251-000T | 1983 | 1025 | GUUGUACCGGAGCCCUUCA | UGAAGGGCUCCGGUACAACUU | 3969 |
| R-008398254-000U | 1688 | 1026 | CGACACCAAGAAGCAGAGA | B CGACACCAAGAAGCAGAGATT B | 3970 |
| R-008398254-000U | 1688 | 1026 | CGACACCAAGAAGCAGAGA | UCUCUGCUUCUUGGUGUCGUU | 3971 |
| R-008398257-000V | 1004 | 1027 | UCACCAGUGGAUUCUGUGU | B UCACCAGUGGAUUCUGUGUTT B | 3972 |
| R-008398257-000V | 1004 | 1027 | UCACCAGUGGAUUCUGUGU | ACACAGAAUCCACUGGUGAUU | 3973 |
| R-008398260-000B | 1631 | 1028 | GGUGACAGGGAAGACAUCA | UGAUGUCUUCCCUGUCACCUU | 3975 |
| R-008398260-000B | 1631 | 1028 | GGUGACAGGGAAGACAUCA | B GGUGACAGGGAAGACAUCATT B | 3974 |
| R-008398263-000C | 1319 | 1029 | UCUAGUAAUAAGCCGGCUA | UAGCCGGCUUAUUACUAGAUU | 3977 |
| R-008398263-000C | 1319 | 1029 | UCUAGUAAUAAGCCGGCUA | B UCUAGUAAUAAGCCGGCUATT B | 3976 |
| R-008398266-000D | 767 | 1030 | GUGGUUAAUAAGGCUGCAG | B GUGGUUAAUAAGGCUGCAGTT B | 3978 |
| R-008398266-000D | 767 | 1030 | GUGGUUAAUAAGGCUGCAG | CUGCAGCCUUAUUAACCACUU | 3979 |
| R-008398269-000E | 841 | 1031 | UCCUCAGAUGGUGUCUGCU | AGCAGACACCAUCUGAGGAUU | 3981 |
| R-008398269-000E | 841 | 1031 | UCCUCAGAUGGUGUCUGCU | B UCCUCAGAUGGUGUCUGCUTT B | 3980 |
| R-008398272-000L | 516 | 1032 | AUGGACAGUAUGCAAUGAC | B AUGGACAGUAUGCAAUGACTT B | 3982 |
| R-008398272-000L | 516 | 1032 | AUGGACAGUAUGCAAUGAC | GUCAUUGCAUACUGUCCAUUU | 3983 |
| R-008398275-000M | 1848 | 1033 | UGCGUGAGCAGGGUGCCAU | AUGGCACCCUGCUCACGCAUU | 3985 |
| R-008398275-000M | 1848 | 1033 | UGCGUGAGCAGGGUGCCAU | B UGCGUGAGCAGGGUGCCAUTT B | 3984 |
| R-008398278-000N | 2202 | 1034 | ACUCUAGGAAUGAAGGUGU | B ACUCUAGGAAUGAAGGUGUTT B | 3986 |
| R-008398278-000N | 2202 | 1034 | ACUCUAGGAAUGAAGGUGU | ACACCUUCAUUCCUAGAGUUU | 3987 |
| R-008398281-000V | 571 | 1035 | GACAUUAGAUGAGGGCAUG | B GACAUUAGAUGAGGGCAUGTT B | 3988 |
| R-008398281-000V | 571 | 1035 | GACAUUAGAUGAGGGCAUG | CAUGCCCUCAUCUAAUGUCUU | 3989 |
| R-008398284-000W | 1629 | 1036 | CUGGUGACAGGGAAGACAU | B CUGGUGACAGGGAAGACAUTT B | 3990 |
| R-008398284-000W | 1629 | 1036 | CUGGUGACAGGGAAGACAU | AUGUCUUCCCUGUCACCAGUU | 3991 |
| R-008398287-000X | 1806 | 1037 | UGAUUCGAAAUCUUGCCCU | B UGAUUCGAAAUCUUGCCCUTT B | 3992 |
| R-008398287-000X | 1806 | 1037 | UGAUUCGAAAUCUUGCCCU | AGGGCAAGAUUUCGAAUCAUU | 3993 |
| R-008398290-000D | 1756 | 1038 | GCUCUUACACCCACCAUCC | B GCUCUUACACCCACCAUCCTT B | 3994 |
| R-008398290-000D | 1756 | 1038 | GCUCUUACACCCACCAUCC | GGAUGGUGGGUGUAAGAGCUU | 3995 |
| R-008398293-000E | 1619 | 1039 | GUCCUUCGGGCUGGUGACA | UGUCACCAGCCCGAAGGACUU | 3997 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398293-000E | 1619 | 1039 | GUCCUUCGGGCUGGUGACA | B GUCCUUCGGGCUGGUGACATT B | 3996 |
| R-008398296-000F | 1610 | 1040 | GUGCGUACUGUCCUUCGGG | B GUGCGUACUGUCCUUCGGGTT B | 3998 |
| R-008398296-000F | 1610 | 1040 | GUGCGUACUGUCCUUCGGG | CCCGAAGGACAGUACGCACUU | 3999 |
| R-008398299-000G | 2500 | 1041 | UGGUGCUGACUAUCCAGUU | B UGGUGCUGACUAUCCAGUUTT B | 4000 |
| R-008398299-000G | 2500 | 1041 | UGGUGCUGACUAUCCAGUU | AACUGGAUAGUCAGCACCAUU | 4001 |
| R-008398302-000Z | 2156 | 1042 | GCUAUUGAAGCUGAGGGAG | B GCUAUUGAAGCUGAGGGAGTT B | 4002 |
| R-008398302-000Z | 2156 | 1042 | GCUAUUGAAGCUGAGGGAG | CUCCCUCAGCUUCAAUAGCUU | 4003 |
| R-008398305-000A | 1189 | 1043 | CAACCAAGAAAGCAAGCUC | GAGCUUGCUUUCUUGGUUGUU | 4005 |
| R-008398305-000A | 1189 | 1043 | CAACCAAGAAAGCAAGCUC | B CAACCAAGAAAGCAAGCUCTT B | 4004 |
| R-008398308-000B | 2066 | 1044 | GUGCAGCUGCUUUAUUCUC | GAGAAUAAAGCAGCUGCACUU | 4007 |
| R-008398308-000B | 2066 | 1044 | GUGCAGCUGCUUUAUUCUC | B GUGCAGCUGCUUUAUUCUCTT B | 4006 |
| R-008398311-000H | 1307 | 1045 | CUAUCUGUCUGCUCUAGUA | UACUAGAGCAGACAGAUAGUU | 4009 |
| R-008398311-000H | 1307 | 1045 | CUAUCUGUCUGCUCUAGUA | B CUAUCUGUCUGCUCUAGUATT B | 4008 |
| R-008398314-000J | 1448 | 1046 | AAACAGGAAGGGAUGGAAG | CUUCCAUCCCUUCCUGUUUUU | 4011 |
| R-008398314-000J | 1448 | 1046 | AAACAGGAAGGGAUGGAAG | B AAACAGGAAGGGAUGGAAGTT B | 4010 |
| R-008398317-000K | 1213 | 1047 | ACUGGCUAGUGGUGGACCC | B ACUGGCUAGUGGUGGACCCTT B | 4012 |
| R-008398317-000K | 1213 | 1047 | ACUGGCUAGUGGUGGACCC | GGGUCCACCACUAGCCAGUUU | 4013 |
| R-008398320-000S | 2119 | 1048 | CCUCUGUGAACUUGCUCAG | B CCUCUGUGAACUUGCUCAGTT B | 4014 |
| R-008398320-000S | 2119 | 1048 | CCUCUGUGAACUUGCUCAG | CUGAGCAAGUUCACAGAGGUU | 4015 |
| R-008398323-000T | 2546 | 72 | CAGGACCUCAUGGAUGGGC | B CAGGACCUCAUGGAUGGGCTT B | 4016 |
| R-008398323-000T | 2546 | 72 | CAGGACCUCAUGGAUGGGC | GCCCAUCCAUGAGGUCCUGUU | 4017 |
| R-008398326-000U | 889 | 1049 | UGUAGAAACAGCUCGUUGU | B UGUAGAAACAGCUCGUUGUTT B | 4018 |
| R-008398326-000U | 889 | 1049 | UGUAGAAACAGCUCGUUGU | ACAACGAGCUGUUUCUACAUU | 4019 |
| R-008398329-000V | 1376 | 1050 | CUGACAGAUCCAAGUCAAC | B CUGACAGAUCCAAGUCAACTT B | 4020 |
| R-008398329-000V | 1376 | 1050 | CUGACAGAUCCAAGUCAAC | GUUGACUUGGAUCUGUCAGUU | 4021 |
| R-008398332-000B | 427 | 1051 | GGAAGAGGAUGUGGAUACC | GGUAUCCACAUCCUCUUCCUU | 4023 |
| R-008398332-000B | 427 | 1051 | GGAAGAGGAUGUGGAUACC | B GGAAGAGGAUGUGGAUACCTT B | 4022 |
| R-008398335-000C | 649 | 1052 | ACCAUCACAGAUGCUGAAA | B ACCAUCACAGAUGCUGAAATT B | 4024 |
| R-008398335-000C | 649 | 1052 | ACCAUCACAGAUGCUGAAA | UUUCAGCAUCUGUGAUGGUUU | 4025 |
| R-008398338-000D | 1915 | 1053 | CCGUACGUCCAUGGGUGGG | B CCGUACGUCCAUGGGUGGGTT B | 4026 |
| R-008398338-000D | 1915 | 1053 | CCGUACGUCCAUGGGUGGG | CCCACCCAUGGACGUACGGUU | 4027 |
| R-008398341-000K | 2053 | 1054 | CAUUCCAUUGUUUGUGCAG | B CAUUCCAUUGUUUGUGCAGTT B | 4028 |
| R-008398341-000K | 2053 | 1054 | CAUUCCAUUGUUUGUGCAG | CUGCACAAACAAUGGAAUGUU | 4029 |
| R-008398344-000L | 2000 | 24 | CACAUCCUAGCUCGGGAUG | CAUCCCGAGCUAGGAUGUGUU | 4031 |
| R-008398344-000L | 2000 | 24 | CACAUCCUAGCUCGGGAUG | B CACAUCCUAGCUCGGGAUGTT B | 4030 |
| R-008398347-000M | 2568 | 1055 | CUCCAGGUGACAGCAAUCA | B CUCCAGGUGACAGCAAUCATT B | 4032 |
| R-008398347-000M | 2568 | 1055 | CUCCAGGUGACAGCAAUCA | UGAUUGCUGUCACCUGGAGUU | 4033 |
| R-008398350-000U | 1739 | 1056 | CUACCAGUUGUGGUUAAGC | GCUUAACCACAACUGGUAGUU | 4035 |
| R-008398350-000U | 1739 | 1056 | CUACCAGUUGUGGUUAAGC | B CUACCAGUUGUGGUUAAGCTT B | 4034 |
| R-008398353-000V | 1746 | 1057 | UUGUGGUUAAGCUCUUACA | B UUGUGGUUAAGCUCUUACATT B | 4036 |
| R-008398353-000V | 1746 | 1057 | UUGUGGUUAAGCUCUUACA | UGUAAGAGCUUAACCACAAUU | 4037 |
| R-008398356-000W | 1321 | 1058 | UAGUAAUAAGCCGGCUAUU | AAUAGCCGGCUUAUUACUAUU | 4039 |
| R-008398356-000W | 1321 | 1058 | UAGUAAUAAGCCGGCUAUU | B UAGUAAUAAGCCGGCUAUUTT B | 4038 |
| R-008398359-000X | 482 | 1059 | CAGUCCUUCACUCAAGAAC | GUUCUUGAGUGAAGGACUGUU | 4041 |
| R-008398359-000X | 482 | 1059 | CAGUCCUUCACUCAAGAAC | B CAGUCCUUCACUCAAGAACTT B | 4040 |
| R-008398362-000D | 280 | 1060 | AGCUGAUUUGAUGGAGUUG | CAACUCCAUCAAAUCAGCUUU | 4043 |
| R-008398362-000D | 280 | 1060 | AGCUGAUUUGAUGGAGUUG | B AGCUGAUUUGAUGGAGUUGTT B | 4042 |
| R-008398365-000E | 1465 | 1061 | AGGUCUCCUUGGGACUCUU | B AGGUCUCCUUGGGACUCUUTT B | 4044 |
| R-008398365-000E | 1465 | 1061 | AGGUCUCCUUGGGACUCUU | AAGAGUCCCAAGGAGACCUUU | 4045 |
| R-008398368-000F | 1731 | 1062 | ACUAUGGACUACCAGUUGU | ACAACUGGUAGUCCAUAGUUU | 4047 |
| R-008398368-000F | 1731 | 1062 | ACUAUGGACUACCAGUUGU | B ACUAUGGACUACCAGUUGUTT B | 4046 |
| R-008398371-000M | 1937 | 1063 | CAGCAGCAAUUUGUGGAGG | B CAGCAGCAAUUUGUGGAGGTT B | 4048 |
| R-008398371-000M | 1937 | 1063 | CAGCAGCAAUUUGUGGAGG | CCUCCACAAAUUGCUGCUGUU | 4049 |
| R-008398374-000N | 1892 | 1064 | CGUGCACAUCAGGAUACCC | B CGUGCACAUCAGGAUACCCTT B | 4050 |
| R-008398374-000N | 1892 | 1064 | CGUGCACAUCAGGAUACCC | GGGUAUCCUGAUGUGCACGUU | 4051 |
| R-008398377-000P | 836 | 1065 | CGUUCUCCUCAGAUGGUGU | B CGUUCUCCUCAGAUGGUGUTT B | 4052 |
| R-008398377-000P | 836 | 1065 | CGUUCUCCUCAGAUGGUGU | ACACCAUCUGAGGAGAACGUU | 4053 |
| R-008398380-000W | 521 | 1066 | CAGUAUGCAAUGACUCGAG | CUCGAGUCAUUGCAUACUGUU | 4055 |
| R-008398380-000W | 521 | 1066 | CAGUAUGCAAUGACUCGAG | B CAGUAUGCAAUGACUCGAGTT B | 4054 |
| R-008398383-000X | 1595 | 1067 | GGUAUAGAGGCUCUUGUGC | GCACAAGAGCCUCUAUACCUU | 4057 |
| R-008398383-000X | 1595 | 1067 | GGUAUAGAGGCUCUUGUGC | B GGUAUAGAGGCUCUUGUGCTT B | 4056 |
| R-008398386-000Y | 2511 | 1068 | AUCCAGUUGAUGGGCUGCC | GGCAGCCCAUCAACUGGAUUU | 4059 |
| R-008398386-000Y | 2511 | 1068 | AUCCAGUUGAUGGGCUGCC | B AUCCAGUUGAUGGGCUGCCTT B | 4058 |
| R-008398389-000Z | 1583 | 1069 | UGCCAAGUGGGUGGUAUAG | B UGCCAAGUGGGUGGUAUAGTT B | 4060 |
| R-008398389-000Z | 1583 | 1069 | UGCCAAGUGGGUGGUAUAG | CUAUACCACCCACUUGGCAUU | 4061 |
| R-008398392-000F | 1897 | 1070 | ACAUCAGGAUACCCAGCGC | GCGCUGGGUAUCCUGAUGUUU | 4063 |
| R-008398392-000F | 1897 | 1070 | ACAUCAGGAUACCCAGCGC | B ACAUCAGGAUACCCAGCGCTT B | 4062 |
| R-008398395-000G | 956 | 1071 | GCCAUCUUUAAGUCUGGAG | CUCCAGACUUAAAGAUGGCUU | 4065 |
| R-008398395-000G | 956 | 1071 | GCCAUCUUUAAGUCUGGAG | B GCCAUCUUUAAGUCUGGAGTT B | 4064 |
| R-008398398-000H | 926 | 1072 | AACCUUCCCAUCAUCGUG | B AACCUUCCCAUCAUCGUGTT B | 4066 |
| R-008398398-000H | 926 | 1072 | AACCUUCCCAUCAUCGUG | CACGAUGAUGGGAAAGGUUUU | 4067 |
| R-008398401-000A | 1874 | 1073 | CUAGUUCAGUUGCUUGUUC | GAACAAGCAACUGAACUAGUU | 4069 |
| R-008398401-000A | 1874 | 1073 | CUAGUUCAGUUGCUUGUUC | B CUAGUUCAGUUGCUUGUUCTT B | 4068 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398404-000B | 488 | 1074 | UUCACUCAAGAACAAGUAG | B UUCACUCAAGAACAAGUAGTT B | 4070 |
| R-008398404-000B | 488 | 1074 | UUCACUCAAGAACAAGUAG | CUACUUGUUCUUGAGUGAAUU | 4071 |
| R-008398407-000C | 1602 | 21 | AGGCUCUUGUGCGUACUGU | B AGGCUCUUGUGCGUACUGUTT B | 4072 |
| R-008398407-000C | 1602 | 21 | AGGCUCUUGUGCGUACUGU | ACAGUACGCACAAGAGCCUUU | 4073 |
| R-008398410-000J | 1695 | 1075 | AAGAAGCAGAGAUGGCCCA | UGGGCCAUCUCUGCUUCUUUU | 4075 |
| R-008398410-000J | 1695 | 1075 | AAGAAGCAGAGAUGGCCCA | B AAGAAGCAGAGAUGGCCCATT B | 4074 |
| R-008398413-000K | 2182 | 1076 | UCCUCUGACAGAGUUACUU | B UCCUCUGACAGAGUUACUUTT B | 4076 |
| R-008398413-000K | 2182 | 1076 | UCCUCUGACAGAGUUACUU | AAGUAACUCUGUCAGAGGAUU | 4077 |
| R-008398416-000L | 2029 | 1077 | AAUUGUUAUCAGAGGACUA | UAGUCCUCUGAUAACAAUUUU | 4079 |
| R-008398416-000L | 2029 | 1077 | AAUUGUUAUCAGAGGACUA | B AAUUGUUAUCAGAGGACUATT B | 4078 |
| R-008398419-000M | 479 | 1078 | UCUCAGUCCUUCACUCAAG | B UCUCAGUCCUUCACUCAAGTT B | 4080 |
| R-008398419-000M | 479 | 1078 | UCUCAGUCCUUCACUCAAG | CUUGAGUGAAGGACUGAGAUU | 4081 |
| R-008398422-000U | 818 | 1079 | UCCAGACACGCUAUCAUGC | GCAUGAUAGCGUGUCUGGAUU | 4083 |
| R-008398422-000U | 818 | 1079 | UCCAGACACGCUAUCAUGC | B UCCAGACACGCUAUCAUGCTT B | 4082 |
| R-008398425-000V | 625 | 1080 | CACUAAUGUCCAGCGUUUG | B CACUAAUGUCCAGCGUUUGTT B | 4084 |
| R-008398425-000V | 625 | 1080 | CACUAAUGUCCAGCGUUUG | CAAACGCUGGACAUUAGUGUU | 4085 |
| R-008398428-000W | 3172 | 1081 | UUGUAACCUGCUGUGAUAC | B UUGUAACCUGCUGUGAUACTT B | 4086 |
| R-008398428-000W | 3172 | 1081 | UUGUAACCUGCUGUGAUAC | GUAUCACAGCAGGUUACAAUU | 4087 |
| R-008398431-000C | 1490 | 1082 | CUUCUGGGUUCAGAUGAUA | B CUUCUGGGUUCAGAUGAUATT B | 4088 |
| R-008398431-000C | 1490 | 1082 | CUUCUGGGUUCAGAUGAUA | UAUCAUCUGAACCCAGAAGUU | 4089 |
| R-008398434-000D | 1914 | 1083 | GCCGUACGUCCAUGGGUGG | B GCCGUACGUCCAUGGGUGGTT B | 4090 |
| R-008398434-000D | 1914 | 1083 | GCCGUACGUCCAUGGGUGG | CCACCCAUGGACGUACGGCUU | 4091 |
| R-008398437-000E | 882 | 100 | CAAAUGAUGUAGAAACAGC | GCUGUUUCUACAUCAUUUGUU | 4093 |
| R-008398437-000E | 882 | 100 | CAAAUGAUGUAGAAACAGC | B CAAAUGAUGUAGAAACAGCTT B | 4092 |
| R-008398440-000L | 1974 | 1084 | UAGUUGAAGGUUGUACCGG | CCGGUACAACCUUCAACUAUU | 4095 |
| R-008398440-000L | 1974 | 1084 | UAGUUGAAGGUUGUACCGG | B UAGUUGAAGGUUGUACCGGTT B | 4094 |
| R-008398443-000M | 2258 | 1085 | GAGGACAAGCCACAAGAUU | B GAGGACAAGCCACAAGAUUTT B | 4096 |
| R-008398443-000M | 2258 | 1085 | GAGGACAAGCCACAAGAUU | AAUCUUGUGGCUUGUCCUCUU | 4097 |
| R-008398446-000N | 2170 | 1086 | GGGAGCCACAGCUCCUCUG | CAGAGGAGCUGUGGCUCCCUU | 4099 |
| R-008398446-000N | 2170 | 1086 | GGGAGCCACAGCUCCUCUG | B GGGAGCCACAGCUCCUCUGTT B | 4098 |
| R-008398449-000P | 1370 | 1087 | CUUCACCUGACAGAUCCAA | B CUUCACCUGACAGAUCCAATT B | 4100 |
| R-008398449-000P | 1370 | 1087 | CUUCACCUGACAGAUCCAA | UUGGAUCUGUCAGGUGAAGUU | 4101 |
| R-008398452-000W | 1429 | 1088 | UCUUUCAGAUGCUGCAACU | B UCUUUCAGAUGCUGCAACUTT B | 4102 |
| R-008398452-000W | 1429 | 1088 | UCUUUCAGAUGCUGCAACU | AGUUGCAGCAUCUGAAAGAUU | 4103 |
| R-008398455-000X | 3173 | 1089 | UGUAACCUGCUGUGAUACG | B UGUAACCUGCUGUGAUACGTT B | 4104 |
| R-008398455-000X | 3173 | 1089 | UGUAACCUGCUGUGAUACG | CGUAUCACAGCAGGUUACAUU | 4105 |
| R-008398458-000Y | 444 | 1090 | CCUCCCAAGUCCUGUAUGA | B CCUCCCAAGUCCUGUAUGATT B | 4106 |
| R-008398458-000Y | 444 | 1090 | CCUCCCAAGUCCUGUAUGA | UCAUACAGGACUUGGGAGGUU | 4107 |
| R-008398461-000E | 1081 | 1091 | GGCAGUGCGUUUAGCUGGU | B GGCAGUGCGUUUAGCUGGUTT B | 4108 |
| R-008398461-000E | 1081 | 1091 | GGCAGUGCGUUUAGCUGGU | ACCAGCUAAACGCACUGCCUU | 4109 |
| R-008398464-000F | 1318 | 1092 | CUCUAGUAAUAAGCCGGCU | AGCCGGCUUAUUACUAGAGUU | 4111 |
| R-008398464-000F | 1318 | 1092 | CUCUAGUAAUAAGCCGGCU | B CUCUAGUAAUAAGCCGGCUTT B | 4110 |
| R-008398467-000G | 329 | 1093 | GCUGUUAGUCACUGGCAGC | B GCUGUUAGUCACUGGCAGCTT B | 4112 |
| R-008398467-000G | 329 | 1093 | GCUGUUAGUCACUGGCAGC | GCUGCCAGUGACUAACAGCUU | 4113 |
| R-008398470-000N | 1389 | 1094 | GUCAACGUCUUGUUCAGAA | UUCUGAACAAGACGUUGACUU | 4115 |
| R-008398470-000N | 1389 | 1094 | GUCAACGUCUUGUUCAGAA | B GUCAACGUCUUGUUCAGAATT B | 4114 |
| R-008398473-000P | 428 | 1095 | GAAGAGGAUGUGGAUACCU | AGGUAUCCACAUCCUCUUCUU | 4117 |
| R-008398473-000P | 428 | 1095 | GAAGAGGAUGUGGAUACCU | B GAAGAGGAUGUGGAUACCUTT B | 4116 |
| R-008398476-000R | 3175 | 1096 | UAACCUGCUGUGAUACGAU | AUCGUAUCACAGCAGGUUAUU | 4119 |
| R-008398476-000R | 3175 | 1096 | UAACCUGCUGUGAUACGAU | B UAACCUGCUGUGAUACGAUTT B | 4118 |
| R-008398479-000S | 1422 | 114 | UCAGGAAUCUUUCAGAUGC | B UCAGGAAUCUUUCAGAUGCTT B | 4120 |
| R-008398479-000S | 1422 | 114 | UCAGGAAUCUUUCAGAUGC | GCAUCUGAAAGAUUCCUGAUU | 4121 |
| R-008398482-000Y | 1500 | 97 | CAGAUGAUAUAAAUGUGGU | ACCACAUUUAUAUCAUCUGUU | 4123 |
| R-008398482-000Y | 1500 | 97 | CAGAUGAUAUAAAUGUGGU | B CAGAUGAUAUAAAUGUGGUTT B | 4122 |
| R-008398485-000Z | 3117 | 1097 | GUUAUUUGGAACCUUGUUU | B GUUAUUUGGAACCUUGUUUTT B | 4124 |
| R-008398485-000Z | 3117 | 1097 | GUUAUUUGGAACCUUGUUU | AAACAAGGUUCCAAAUAACUU | 4125 |
| R-008398488-000A | 2020 | 1098 | UCACAACCGAAUUGUUAUC | B UCACAACCGAAUUGUUAUCTT B | 4126 |
| R-008398488-000A | 2020 | 1098 | UCACAACCGAAUUGUUAUC | GAUAACAAUUCGGUUGUGAUU | 4127 |
| R-008398491-000G | 1625 | 1099 | CGGGCUGGUGACAGGGAAG | B CGGGCUGGUGACAGGGAAGTT B | 4128 |
| R-008398491-000G | 1625 | 1099 | CGGGCUGGUGACAGGGAAG | CUUCCCUGUCACCAGCCCGUU | 4129 |
| R-008398494-000H | 2022 | 1100 | ACAACCGAAUUGUUAUCAG | B ACAACCGAAUUGUUAUCAGTT B | 4130 |
| R-008398494-000H | 2022 | 1100 | ACAACCGAAUUGUUAUCAG | CUGAUAACAAUUCGGUUGUUU | 4131 |
| R-008398497-000J | 624 | 1101 | CCACUAAUGUCCAGCGUUU | B CCACUAAUGUCCAGCGUUUTT B | 4132 |
| R-008398497-000J | 624 | 1101 | CCACUAAUGUCCAGCGUUU | AAACGCUGGACAUUAGUGGUU | 4133 |
| R-008398500-000B | 1648 | 1102 | CACUGAGCCUGCCAUCUGU | ACAGAUGGCAGGCUCAGUGUU | 4135 |
| R-008398500-000B | 1648 | 1102 | CACUGAGCCUGCCAUCUGU | B CACUGAGCCUGCCAUCUGUTT B | 4134 |
| R-008398503-000C | 790 | 1103 | GGUCCAUCAGCUUUCUAAA | B GGUCCAUCAGCUUUCUAAATT B | 4136 |
| R-008398503-000C | 790 | 1103 | GGUCCAUCAGCUUUCUAAA | UUUAGAAAGCUGAUGGACCUU | 4137 |
| R-008398506-000D | 2122 | 59 | CUGUGAACUUGCUCAGGAC | B CUGUGAACUUGCUCAGGACTT B | 4138 |
| R-008398506-000D | 2122 | 59 | CUGUGAACUUGCUCAGGAC | GUCCUGAGCAAGUUCACAGUU | 4139 |
| R-008398509-000E | 3160 | 1104 | AUCCCAAAGUUGUUGUAAC | B AUCCCAAAGUUGUUGUAACTT B | 4140 |
| R-008398509-000E | 3160 | 1104 | AUCCCAAAGUUGUUGUAAC | GUUACAACAACUUUGGGAUUU | 4141 |
| R-008398512-000L | 1251 | 1105 | UGAGGACCUAUACUUACGA | B UGAGGACCUAUACUUACGATT B | 4142 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
| --- | --- | --- | --- | --- | --- |
| R-008398512-000L | 1251 | 1105 | UGAGGACCUAUACUUACGA | UCGUAAGUAUAGGUCCUCAUU | 4143 |
| R-008398518-000N | 2253 | 1106 | UGUCUGAGGACAAGCCACA | UGUGGCUUGUCCUCAGACAUU | 4145 |
| R-008398518-000N | 2253 | 1106 | UGUCUGAGGACAAGCCACA | B UGUCUGAGGACAAGCCACATT B | 4144 |
| R-008398521-000V | 2515 | 1107 | AGUUGAUGGGCUGCCAGAU | B AGUUGAUGGGCUGCCAGAUTT B | 4146 |
| R-008398521-000V | 2515 | 1107 | AGUUGAUGGGCUGCCAGAU | AUCUGGCAGCCCAUCAACUUU | 4147 |
| R-008398524-000W | 1680 | 1108 | UGACCAGCCGACACCAAGA | B UGACCAGCCGACACCAAGATT B | 4148 |
| R-008398524-000W | 1680 | 1108 | UGACCAGCCGACACCAAGA | UCUUGGUGUCGGCUGGUCAUU | 4149 |
| R-008398527-000X | 2169 | 1109 | AGGGAGCCACAGCUCCUCU | B AGGGAGCCACAGCUCCUCUTT B | 4150 |
| R-008398527-000X | 2169 | 1109 | AGGGAGCCACAGCUCCUCU | AGAGGAGCUGUGGCUCCCUUU | 4151 |
| R-008398530-000D | 3165 | 1110 | AAAGUUGUUGUAACCUGCU | AGCAGGUUACAACAACUUUUU | 4153 |
| R-008398530-000D | 3165 | 1110 | AAAGUUGUUGUAACCUGCU | B AAAGUUGUUGUAACCUGCUTT B | 4152 |
| R-008398533-000E | 780 | 1111 | CUGCAGUUAUGGUCCAUCA | UGAUGGACCAUAACUGCAGUU | 4155 |
| R-008398533-000E | 780 | 1111 | CUGCAGUUAUGGUCCAUCA | B CUGCAGUUAUGGUCCAUCATT B | 4154 |
| R-008398536-000F | 1978 | 1112 | UGAAGGUUGUACCGGAGCC | B UGAAGGUUGUACCGGAGCCTT B | 4156 |
| R-008398536-000F | 1978 | 1112 | UGAAGGUUGUACCGGAGCC | GGCUCCGGUACAACCUUCAUU | 4157 |
| R-008398539-000G | 661 | 122 | GCUGAAACAUGCAGUUGUA | B GCUGAAACAUGCAGUUGUATT B | 4158 |
| R-008398539-000G | 661 | 122 | GCUGAAACAUGCAGUUGUA | UACAACUGCAUGUUUCAGCUU | 4159 |
| R-008398542-000N | 1354 | 181 | AAUGCAAGCUUUAGGACUU | B AAUGCAAGCUUUAGGACUUTT B | 4160 |
| R-008398542-000N | 1354 | 181 | AAUGCAAGCUUUAGGACUU | AAGUCCUAAAGCUUGCAUUUU | 4161 |
| R-008398545-000P | 563 | 1113 | UUCCCUGAGACAUUAGAUG | B UUCCCUGAGACAUUAGAUGTT B | 4162 |
| R-008398545-000P | 563 | 1113 | UUCCCUGAGACAUUAGAUG | CAUCUAAUGUCUCAGGGAAUU | 4163 |
| R-008398548-000R | 1622 | 1114 | CUUCGGGCUGGUGACAGGG | B CUUCGGGCUGGUGACAGGGTT B | 4164 |
| R-008398548-000R | 1622 | 1114 | CUUCGGGCUGGUGACAGGG | CCCUGUCACCAGCCCGAAGUU | 4165 |
| R-008398551-000X | 2295 | 1115 | UUGAGCUGACCAGCUCUCU | AGAGAGCUGGUCAGCUCAAUU | 4167 |
| R-008398551-000X | 2295 | 1115 | UUGAGCUGACCAGCUCUCU | B UUGAGCUGACCAGCUCUCUTT B | 4166 |
| R-008398554-000Y | 2126 | 1116 | GAACUUGCUCAGGACAAGG | CCUUGUCCUGAGCAAGUUCUU | 4169 |
| R-008398554-000Y | 2126 | 1116 | GAACUUGCUCAGGACAAGG | B GAACUUGCUCAGGACAAGGTT B | 4168 |
| R-008398557-000Z | 1683 | 1117 | CCAGCCGACACCAAGAAGC | GCUUCUUGGUGUCGGCUGGUU | 4171 |
| R-008398557-000Z | 1683 | 1117 | CCAGCCGACACCAAGAAGC | B CCAGCCGACACCAAGAAGCTT B | 4170 |
| R-008398560-000F | 1857 | 1118 | AGGGUGCCAUUCCACGACU | AGUCGUGGAAUGGCACCCUUU | 4173 |
| R-008398560-000F | 1857 | 1118 | AGGGUGCCAUUCCACGACU | B AGGGUGCCAUUCCACGACUTT B | 4172 |
| R-008398563-000G | 2064 | 1119 | UUGUGCAGCUGCUUUAUUC | GAAUAAAGCAGCUGCACAAUU | 4175 |
| R-008398563-000G | 2064 | 1119 | UUGUGCAGCUGCUUUAUUC | B UUGUGCAGCUGCUUUAUUCTT B | 4174 |
| R-008398566-000H | 1245 | 31 | AUAUAAUGAGGACCUAUAC | GUAUAGGUCCUCAUUAUAUUU | 4177 |
| R-008398566-000H | 1245 | 31 | AUAUAAUGAGGACCUAUAC | B AUAUAAUGAGGACCUAUACTT B | 4176 |
| R-008398569-000J | 489 | 1120 | UCACUCAAGAACAAGUAGC | B UCACUCAAGAACAAGUAGCTT B | 4178 |
| R-008398569-000J | 489 | 1120 | UCACUCAAGAACAAGUAGC | GCUACUUGUUCUUGAGUGAUU | 4179 |
| R-008398572-000R | 1346 | 1121 | GCUGGUGGAAUGCAAGCUU | B GCUGGUGGAAUGCAAGCUUTT B | 4180 |
| R-008398572-000R | 1346 | 1121 | GCUGGUGGAAUGCAAGCUU | AAGCUUGCAUUCCACCAGCUU | 4181 |
| R-008398575-000S | 1442 | 1122 | GCAACUAAACAGGAAGGGA | UCCCUUCCUGUUUAGUUGCUU | 4183 |
| R-008398575-000S | 1442 | 1122 | GCAACUAAACAGGAAGGGA | B GCAACUAAACAGGAAGGGATT B | 4182 |
| R-008398578-000T | 1981 | 1123 | AGGUUGUACCGGAGCCCUU | B AGGUUGUACCGGAGCCCUUTT B | 4184 |
| R-008398578-000T | 1981 | 1123 | AGGUUGUACCGGAGCCCUU | AAGGGCUCCGGUACAACCUUU | 4185 |
| R-008398581-000Z | 777 | 1124 | AGGCUGCAGUUAUGGUCCA | UGGACCAUAACUGCAGCCUUU | 4187 |
| R-008398581-000Z | 777 | 1124 | AGGCUGCAGUUAUGGUCCA | B AGGCUGCAGUUAUGGUCCATT B | 4186 |
| R-008398584-000A | 589 | 1125 | GCAGAUCCCAUCUACACAG | CUGUGUAGAUGGGAUCUGCUU | 4189 |
| R-008398584-000A | 589 | 1125 | GCAGAUCCCAUCUACACAG | B GCAGAUCCCAUCUACACAGTT B | 4188 |
| R-008398587-000B | 2205 | 1126 | CUAGGAAUGAAGGUGUGGC | GCCACACCUUCAUUCCUAGUU | 4191 |
| R-008398587-000B | 2205 | 1126 | CUAGGAAUGAAGGUGUGGC | B CUAGGAAUGAAGGUGUGGCTT B | 4190 |
| R-008398590-000H | 394 | 1127 | AGCUCCUUCUCUGAGUGGU | B AGCUCCUUCUCUGAGUGGUTT B | 4192 |
| R-008398590-000H | 394 | 1127 | AGCUCCUUCUCUGAGUGGU | AC CACUCAGAGAAGGAGCUUU | 4193 |
| R-008398593-000J | 1035 | 1128 | UUACAACUCUCCACAACCU | B UUACAACUCUCCACAACCUTT B | 4194 |
| R-008398593-000J | 1035 | 1128 | UUACAACUCUCCACAACCU | AGGUUGUGGAGAGUUGUAAUU | 4195 |
| R-008398605-000E | 410 | 1129 | GGUAAAGGCAAUCCUGAGG | B GGUAAAGGCAAUCCUGAGGTT B | 4196 |
| R-008398605-000E | 410 | 1129 | GGUAAAGGCAAUCCUGAGG | CCUCAGGAUUGCCUUUACCUU | 4197 |
| R-008398608-000F | 1721 | 1130 | GUUCGCCUUCACUAUGGAC | GUCCAUAGUGAAGGCGAACUU | 4199 |
| R-008398608-000F | 1721 | 1130 | GUUCGCCUUCACUAUGGAC | B GUUCGCCUUCACUAUGGACTT B | 4198 |
| R-008398611-000M | 1134 | 1131 | CAAAUGUUAAAUUCUUGGC | GCCAAGAAUUUAACAUUUGUU | 4201 |
| R-008398611-000M | 1134 | 1131 | CAAAUGUUAAAUUCUUGGC | B CAAAUGUUAAAUUCUUGGCTT B | 4200 |
| R-008398614-000N | 3182 | 1132 | CUGUGAUACGAUGCUUCAA | B CUGUGAUACGAUGCUUCAATT B | 4202 |
| R-008398614-000N | 3182 | 1132 | CUGUGAUACGAUGCUUCAA | UUGAAGCAUCGUAUCACAGUU | 4203 |
| R-008398617-000P | 881 | 1133 | ACAAAUGAUGUAGAAACAG | B ACAAAUGAUGUAGAAACAGTT B | 4204 |
| R-008398617-000P | 881 | 1133 | ACAAAUGAUGUAGAAACAG | CUGUUUCUACAUCAUUUGUUU | 4205 |
| R-008398620-000W | 547 | 1134 | GGUACGAGCUGCUAUGUUC | GAACAUAGCAGCUCGUACCUU | 4207 |
| R-008398620-000W | 547 | 1134 | GGUACGAGCUGCUAUGUUC | B GGUACGAGCUGCUAUGUUCTT B | 4206 |
| R-008398623-000X | 2028 | 1135 | GAAUUGUUAUCAGAGGACU | AGUCCUCUGAUAACAAUUCUU | 4209 |
| R-008398623-000X | 2028 | 1135 | GAAUUGUUAUCAGAGGACU | B GAAUUGUUAUCAGAGGACUTT B | 4208 |
| R-008398629-000Z | 2023 | 1136 | CAACCGAAUUGUUAUCAGA | B CAACCGAAUUGUUAUCAGATT B | 4210 |
| R-008398629-000Z | 2023 | 1136 | CAACCGAAUUGUUAUCAGA | UCUGAUAACAAUUCGGUUGUU | 4211 |
| R-008398632-000F | 3184 | 1137 | GUGAUACGAUGCUUCAAGA | B GUGAUACGAUGCUUCAAGATT B | 4212 |
| R-008398632-000F | 3184 | 1137 | GUGAUACGAUGCUUCAAGA | UCUUGAAGCAUCGUAUCACUU | 4213 |
| R-008398635-000G | 413 | 1138 | AAAGGCAAUCCUGAGGAAG | CUUCCUCAGGAUUGCCUUUUU | 4215 |
| R-008398635-000G | 413 | 1138 | AAAGGCAAUCCUGAGGAAG | B AAAGGCAAUCCUGAGGAAGTT B | 4214 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398638-000H | 2178 | 1139 | CAGCUCCUCUGACAGAGUU | B CAGCUCCUCUGACAGAGUUTT B | 4216 |
| R-008398638-000H | 2178 | 1139 | CAGCUCCUCUGACAGAGUU | AACUCUGUCAGAGGAGCUGUU | 4217 |
| R-008398641-000P | 618 | 143 | CUCAUCCCACUAAUGUCCA | B CUCAUCCCACUAAUGUCCATT B | 4218 |
| R-008398641-000P | 618 | 143 | CUCAUCCCACUAAUGUCCA | UGGACAUUAGUGGGAUGAGUU | 4219 |
| R-008398644-000R | 1577 | 1140 | AUGGUCUGCCAAGUGGGUG | B AUGGUCUGCCAAGUGGGUGTT B | 4220 |
| R-008398644-000R | 1577 | 1140 | AUGGUCUGCCAAGUGGGUG | CACCCACUUGGCAGACCAUU | 4221 |
| R-008398647-000S | 1793 | 1141 | GCUACUGUUGGAUUGAUUC | GAAUCAAUCCAACAGUAGCUU | 4223 |
| R-008398647-000S | 1793 | 1141 | GCUACUGUUGGAUUGAUUC | B GCUACUGUUGGAUUGAUUCTT B | 4222 |
| R-008398650-000Y | 526 | 1142 | UGCAAUGACUCGAGCUCAG | B UGCAAUGACUCGAGCUCAGTT B | 4224 |
| R-008398650-000Y | 526 | 1142 | UGCAAUGACUCGAGCUCAG | CUGAGCUCGAGUCAUUGCAUU | 4225 |
| R-008398653-000Z | 2358 | 1143 | GACUUGAUAUUGGUGCCCA | UGGGCACCAAUAUCAAGUCUU | 4227 |
| R-008398653-000Z | 2358 | 1143 | GACUUGAUAUUGGUGCCCA | B GACUUGAUAUUGGUGCCCATT B | 4226 |
| R-008398656-000A | 852 | 11 | UGUCUGCUAUUGUACGUAC | B UGUCUGCUAUUGUACGUACTT B | 4228 |
| R-008398656-000A | 852 | 11 | UGUCUGCUAUUGUACGUAC | GUACGUACAAUAGCAGACAUU | 4229 |
| R-008398659-000B | 1403 | 1144 | CAGAACUGUCUUUGGACUC | GAGUCCAAAGACAGUUCUGUU | 4231 |
| R-008398659-000B | 1403 | 1144 | CAGAACUGUCUUUGGACUC | B CAGAACUGUCUUUGGACUCTT B | 4230 |
| R-008398662-000H | 1875 | 1145 | UAGUUCAGUUGCUUGUUCG | CGAACAAGCAACUGAACUAUU | 4233 |
| R-008398662-000H | 1875 | 1145 | UAGUUCAGUUGCUUGUUCG | B UAGUUCAGUUGCUUGUUCGTT B | 4232 |
| R-008398665-000J | 1160 | 1146 | ACAGACUGCCUUCAAAUUU | B ACAGACUGCCUUCAAAUUUTT B | 4234 |
| R-008398665-000J | 1160 | 1146 | ACAGACUGCCUUCAAAUUU | AAAUUUGAAGGCAGUCUGUU | 4235 |
| R-008398668-000K | 1591 | 1147 | GGGUGGUAUAGAGGCUCUU | AAGAGCCUCUAUACCACCCUU | 4237 |
| R-008398668-000K | 1591 | 1147 | GGGUGGUAUAGAGGCUCUU | B GGGUGGUAUAGAGGCUCUUTT B | 4236 |
| R-008398671-000S | 1734 | 1148 | AUGGACUACCAGUUGUGGU | B AUGGACUACCAGUUGUGGUTT B | 4238 |
| R-008398671-000S | 1734 | 1148 | AUGGACUACCAGUUGUGGU | ACCACAACUGGUAGUCCAUU | 4239 |
| R-008398674-000T | 2030 | 1149 | AUUGUUAUCAGAGGACUAA | UUAGUCCUCUGAUAACAAUUU | 4241 |
| R-008398674-000T | 2030 | 1149 | AUUGUUAUCAGAGGACUAA | B AUUGUUAUCAGAGGACUAATT B | 4240 |
| R-008398677-000U | 775 | 1150 | UAAGGCUGCAGUUAUGGUC | GACCAUAACUGCAGCCUUAUU | 4243 |
| R-008398677-000U | 775 | 1150 | UAAGGCUGCAGUUAUGGUC | B UAAGGCUGCAGUUAUGGUCTT B | 4242 |
| R-008398680-000A | 1813 | 1151 | AAAUCUUGCCCUUUGUCCC | GGGACAAAGGGCAAGAUUUUU | 4245 |
| R-008398680-000A | 1813 | 1151 | AAAUCUUGCCCUUUGUCCC | B AAAUCUUGCCCUUUGUCCCTT B | 4244 |
| R-008398683-000B | 1938 | 1152 | AGCAGCAAUUUGUGGAGGG | B AGCAGCAAUUUGUGGAGGGTT B | 4246 |
| R-008398683-000B | 1938 | 1152 | AGCAGCAAUUUGUGGAGGG | CCCUCCACAAAUUGCUGCUU | 4247 |
| R-008398686-000C | 2039 | 1153 | AGAGGACUAAAUACCAUUC | B AGAGGACUAAAUACCAUUCTT B | 4248 |
| R-008398686-000C | 2039 | 1153 | AGAGGACUAAAUACCAUUC | GAAUGGUAUUUAGUCCUCUUU | 4249 |
| R-008398689-000D | 1297 | 1154 | GCUGAAGGUGCUAUCUGUC | B GCUGAAGGUGCUAUCUGUCTT B | 4250 |
| R-008398689-000D | 1297 | 1154 | GCUGAAGGUGCUAUCUGUC | GACAGAUAGCACCUUCAGCUU | 4251 |
| R-008398692-000K | 456 | 1155 | UGUAUGAGUGGGAACAGGG | CCCUGUUCCCACUCAUACAUU | 4253 |
| R-008398692-000K | 456 | 1155 | UGUAUGAGUGGGAACAGGG | B UGUAUGAGUGGGAACAGGGTT B | 4252 |
| R-008398695-000L | 869 | 51 | ACCAUGCAGAAUACAAAUG | B ACCAUGCAGAAUACAAAUGTT B | 4254 |
| R-008398695-000L | 869 | 51 | ACCAUGCAGAAUACAAAUG | CAUUUGUAUUCUGCAUGGUUU | 4255 |
| R-008398698-000M | 590 | 1156 | CAGAUCCCAUCUACACAGU | B CAGAUCCCAUCUACACAGUTT B | 4256 |
| R-008398698-000M | 590 | 1156 | CAGAUCCCAUCUACACAGU | ACUGUGUAGAUGGGAUCUGUU | 4257 |
| R-008398701-000E | 1933 | 1157 | GACACAGCAGCAAUUUGUG | B GACACAGCAGCAAUUUGUGTT B | 4258 |
| R-008398701-000E | 1933 | 1157 | GACACAGCAGCAAUUUGUG | CACAAAUUGCUGCUGUGUCUU | 4259 |
| R-008398704-000F | 583 | 1158 | GGGCAUGCAGAUCCCAUCU | AGAUGGGAUCUGCAUGCCCUU | 4261 |
| R-008398704-000F | 583 | 1158 | GGGCAUGCAGAUCCCAUCU | B GGGCAUGCAGAUCCCAUCUTT B | 4260 |
| R-008398707-000G | 2540 | 1159 | CAUGCCCAGGACCUCAUGG | B CAUGCCCAGGACCUCAUGGTT B | 4262 |
| R-008398707-000G | 2540 | 1159 | CAUGCCCAGGACCUCAUGG | CCAUGAGGUCCUGGGCAUGUU | 4263 |
| R-008398710-000N | 2162 | 1160 | GAAGCUGAGGGAGCCACAG | B GAAGCUGAGGGAGCCACAGTT B | 4264 |
| R-008398710-000N | 2162 | 1160 | GAAGCUGAGGGAGCCACAG | CUGUGGCUCCCUCAGCUUCUU | 4265 |
| R-008398713-000P | 330 | 1161 | CUGUUAGUCACUGGCAGCA | B CUGUUAGUCACUGGCAGCATT B | 4266 |
| R-008398713-000P | 330 | 1161 | CUGUUAGUCACUGGCAGCA | UGCUGCCAGUGACUAACAGUU | 4267 |
| R-008398716-000R | 1481 | 1162 | CUUGUUCAGCUUCUGGGUU | B CUUGUUCAGCUUCUGGGUUTT B | 4268 |
| R-008398716-000R | 1481 | 1162 | CUUGUUCAGCUUCUGGGUU | AACCCAGAAGCUGAACAAGUU | 4269 |
| R-008398719-000S | 1612 | 22 | GCGUACUGUCCUUCGGGCU | AGCCCGAAGGACAGUACGCUU | 4271 |
| R-008398719-000S | 1612 | 22 | GCGUACUGUCCUUCGGGCU | B GCGUACUGUCCUUCGGGCUTT B | 4270 |
| R-008398722-000Y | 1709 | 3 | GCCCAGAAUGCAGUUCGCC | GGCGAACUGCAUUCUGGGCUU | 4273 |
| R-008398722-000Y | 1709 | 3 | GCCCAGAAUGCAGUUCGCC | B GCCCAGAAUGCAGUUCGCCTT B | 4272 |
| R-008398725-000Z | 1344 | 1163 | AAGCUGGUGGAAUGCAAGC | GCUUGCAUUCCACCAGCUUUU | 4275 |
| R-008398725-000Z | 1344 | 1163 | AAGCUGGUGGAAUGCAAGC | B AAGCUGGUGGAAUGCAAGCTT B | 4274 |
| R-008398728-000A | 431 | 1164 | GAGGAUGUGGAUACCUCCC | GGGAGGUAUCCACAUCCUCUU | 4277 |
| R-008398728-000A | 431 | 1164 | GAGGAUGUGGAUACCUCCC | B GAGGAUGUGGAUACCUCCCTT B | 4276 |
| R-008398731-000G | 1508 | 1165 | AUAAAUGUGGUCACCUGUG | CACAGGUGACCACAUUUAUUU | 4279 |
| R-008398731-000G | 1508 | 1165 | AUAAAUGUGGUCACCUGUG | B AUAAAUGUGGUCACCUGUGTT B | 4278 |
| R-008398734-000H | 1918 | 1166 | UACGUCCAUGGGUGGGACA | B UACGUCCAUGGGUGGGACATT B | 4280 |
| R-008398734-000H | 1918 | 1166 | UACGUCCAUGGGUGGGACA | UGUCCCACCCAUGGACGUAUU | 4281 |
| R-008398737-000J | 289 | 1167 | GAUGGAGUUGGACAUGGCC | GGCCAUGUCCAACUCCAUCUU | 4283 |
| R-008398737-000J | 289 | 1167 | GAUGGAGUUGGACAUGGCC | B GAUGGAGUUGGACAUGGCCTT B | 4282 |
| R-008398740-000R | 631 | 1168 | UGUCCAGCGUUUGGCUGAA | B UGUCCAGCGUUUGGCUGAATT B | 4284 |
| R-008398740-000R | 631 | 1168 | UGUCCAGCGUUUGGCUGAA | UUCAGCCAAACGCUGGACAUU | 4285 |
| R-008398743-000S | 1642 | 60 | AGACAUCACUGAGCCUGCC | B AGACAUCACUGAGCCUGCCTT B | 4286 |
| R-008398743-000S | 1642 | 60 | AGACAUCACUGAGCCUGCC | GGCAGGCUCAGUGAUGUCUUU | 4287 |
| R-008398746-000T | 1853 | 1169 | GAGCAGGUGCCAUUCCAC | B GAGCAGGUGCCAUUCCACTT B | 4288 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398746-000T | 1853 | 1169 | GAGCAGGGUGCCAUUCCAC | GUGGAAUGGCACCCUGCUCUU | 4289 |
| R-008398749-000U | 1243 | 1170 | AAAUAUAAUGAGGACCUAU | AUAGGUCCUCAUUAUAUUUUU | 4291 |
| R-008398749-000U | 1243 | 1170 | AAAUAUAAUGAGGACCUAU | B AAAUAUAAUGAGGACCUAUTT B | 4290 |
| R-008398752-000A | 1212 | 1171 | UACUGGCUAGUGGUGGACC | GGUCCACCACUAGCCAGUAUU | 4293 |
| R-008398752-000A | 1212 | 1171 | UACUGGCUAGUGGUGGACC | B UACUGGCUAGUGGUGGACCTT B | 4292 |
| R-008398755-000B | 996 | 1172 | UGCUUGGUUCACCAGUGGA | UCCACUGGUGAACCAAGCAUU | 4295 |
| R-008398755-000B | 996 | 1172 | UGCUUGGUUCACCAGUGGA | B UGCUUGGUUCACCAGUGGATT B | 4294 |
| R-008398758-000C | 2256 | 1173 | CUGAGGACAAGCCACAAGA | B CUGAGGACAAGCCACAAGATT B | 4296 |
| R-008398758-000C | 2256 | 1173 | CUGAGGACAAGCCACAAGA | UCUUGUGGCUUGUCCUCAGUU | 4297 |
| R-008398761-000J | 1607 | 1174 | CUUGUGCGUACUGUCCUUC | GAAGGACAGUACGCACAAGUU | 4299 |
| R-008398761-000J | 1607 | 1174 | CUUGUGCGUACUGUCCUUC | B CUUGUGCGUACUGUCCUUCTT B | 4298 |
| R-008398764-000K | 3116 | 1175 | UGUUAUUUGGAACCUUGUU | B UGUUAUUUGGAACCUUGUUTT B | 4300 |
| R-008398764-000K | 3116 | 1175 | UGUUAUUUGGAACCUUGUU | AACAAGGUUCCAAAUAACAUU | 4301 |
| R-008398767-000L | 1179 | 1176 | UAGCUUAUGGCAACCAAGA | UCUUGGUUGCCAUAAGCAUU | 4303 |
| R-008398767-000L | 1179 | 1176 | UAGCUUAUGGCAACCAAGA | B UAGCUUAUGGCAACCAAGATT B | 4302 |
| R-008398770-000T | 3185 | 1177 | UGAUACGAUGCUUCAAGAG | CUCUUGAAGCAUCGUAUCAUU | 4305 |
| R-008398770-000T | 3185 | 1177 | UGAUACGAUGCUUCAAGAG | B UGAUACGAUGCUUCAAGAGTT B | 4304 |
| R-008398773-000U | 1594 | 1178 | UGGUAUAGAGGCUCUUGUG | CACAAGAGCCUCUAUACCAUU | 4307 |
| R-008398773-000U | 1594 | 1178 | UGGUAUAGAGGCUCUUGUG | B UGGUAUAGAGGCUCUUGUGTT B | 4306 |
| R-008398776-000V | 887 | 1179 | GAUGUAGAAACAGCUCGUU | B GAUGUAGAAACAGCUCGUUTT B | 4308 |
| R-008398776-000V | 887 | 1179 | GAUGUAGAAACAGCUCGUU | AACGAGCUGUUUCUACAUCUU | 4309 |
| R-008398779-000W | 928 | 1180 | CCUUUCCCAUCAUCGUGAG | B CCUUUCCCAUCAUCGUGAGTT B | 4310 |
| R-008398779-000W | 928 | 1180 | CCUUUCCCAUCAUCGUGAG | CUCACGAUGAUGGGAAAGGUU | 4311 |
| R-008398782-000C | 835 | 1181 | GCGUUCUCCUCAGAUGGUG | CACCAUCUGAGGAGAACGCUU | 4313 |
| R-008398782-000C | 835 | 1181 | GCGUUCUCCUCAGAUGGUG | B GCGUUCUCCUCAGAUGGUGTT B | 4312 |
| R-008398785-000D | 1900 | 1182 | UCAGGAUACCCAGCGCCGU | B UCAGGAUACCCAGCGCCGUTT B | 4314 |
| R-008398785-000D | 1900 | 1182 | UCAGGAUACCCAGCGCCGU | ACGGCGCUGGGUAUCCUGAUU | 4315 |
| R-008398788-000E | 2284 | 1183 | ACGGCUUUCAGUUGAGCUG | B ACGGCUUUCAGUUGAGCUGTT B | 4316 |
| R-008398788-000E | 2284 | 1183 | ACGGCUUUCAGUUGAGCUG | CAGCUCAACUGAAAGCCGUUU | 4317 |
| R-008398791-000L | 1976 | 1184 | GUUGAAGGUUGUACCGGAG | CUCCGGUACAACCUUCAACUU | 4319 |
| R-008398791-000L | 1976 | 1184 | GUUGAAGGUUGUACCGGAG | B GUUGAAGGUUGUACCGGAGTT B | 4318 |
| R-008398794-000M | 2393 | 1185 | UAUCGCCAGGAUGAUCCUA | B UAUCGCCAGGAUGAUCCUATT B | 4320 |
| R-008398794-000M | 2393 | 1185 | UAUCGCCAGGAUGAUCCUA | UAGGAUCAUCCUGGCGAUAUU | 4321 |
| R-008398797-000N | 1295 | 1186 | GUGCUGAAGGUGCUAUCUG | B GUGCUGAAGGUGCUAUCUGTT B | 4322 |
| R-008398797-000N | 1295 | 1186 | GUGCUGAAGGUGCUAUCUG | CAGAUAGCACCUUCAGCACUU | 4323 |
| R-008398800-000F | 1410 | 1187 | GUCUUUGGACUCUCAGGAA | UUCCUGAGAGUCCAAAGACUU | 4325 |
| R-008398800-000F | 1410 | 1187 | GUCUUUGGACUCUCAGGAA | B GUCUUUGGACUCUCAGGAATT B | 4324 |
| R-008398803-000G | 1457 | 1188 | GGGAUGGAAGGUCUCCUUG | B GGGAUGGAAGGUCUCCUUGTT B | 4326 |
| R-008398803-000G | 1457 | 1188 | GGGAUGGAAGGUCUCCUUG | CAAGGAGACCUUCCAUCCCUU | 4327 |
| R-008398806-000H | 2296 | 1189 | UGAGCUGACCAGCUCUCUC | B UGAGCUGACCAGCUCUCUCTT B | 4328 |
| R-008398806-000H | 2296 | 1189 | UGAGCUGACCAGCUCUCUC | GAGAGAGCUGGUCAGCUCAUU | 4329 |
| R-008398809-000J | 929 | 1190 | CUUUCCCAUCAUCGUGAGG | CCUCACGAUGAUGGGAAAGUU | 4331 |
| R-008398809-000J | 929 | 1190 | CUUUCCCAUCAUCGUGAGG | B CUUUCCCAUCAUCGUGAGGTT B | 4330 |
| R-008398812-000R | 1359 | 1191 | AAGCUUUAGGACUUCACCU | B AAGCUUUAGGACUUCACCUTT B | 4332 |
| R-008398812-000R | 1359 | 1191 | AAGCUUUAGGACUUCACCU | AGGUGAAGUCCUAAAGCUUUU | 4333 |
| R-008398815-000S | 1351 | 1192 | UGGAAUGCAAGCUUUAGGA | B UGGAAUGCAAGCUUUAGGATT B | 4334 |
| R-008398815-000S | 1351 | 1192 | UGGAAUGCAAGCUUUAGGA | UCCUAAAGCUUGCAUUCCAUU | 4335 |
| R-008398818-000T | 969 | 1193 | CUGGAGGCAUUCCUGCCCU | B CUGGAGGCAUUCCUGCCCUTT B | 4336 |
| R-008398818-000T | 969 | 1193 | CUGGAGGCAUUCCUGCCCU | AGGGCAGGAAUGCCUCCAGUU | 4337 |
| R-008398821-000Z | 1876 | 1194 | AGUUCAGUUGCUUGUUCGU | ACGAACAAGCAACUGAACUUU | 4339 |
| R-008398821-000Z | 1876 | 1194 | AGUUCAGUUGCUUGUUCGU | B AGUUCAGUUGCUUGUUCGUTT B | 4338 |
| R-008398824-000A | 552 | 1195 | GAGCUGCUAUGUUCCCUGA | B GAGCUGCUAUGUUCCCUGATT B | 4340 |
| R-008398824-000A | 552 | 1195 | GAGCUGCUAUGUUCCCUGA | UCAGGGAACAUAGCAGCUCUU | 4341 |
| R-008398827-000B | 2441 | 1196 | GGCCAGGAUGCCUUGGGUA | B GGCCAGGAUGCCUUGGGUATT B | 4342 |
| R-008398827-000B | 2441 | 1196 | GGCCAGGAUGCCUUGGGUA | UACCCAAGGCAUCCUGGCCUU | 4343 |
| R-008398830-000H | 2402 | 1197 | GAUGAUCCUAGCUAUCGUU | B GAUGAUCCUAGCUAUCGUUTT B | 4344 |
| R-008398830-000H | 2402 | 1197 | GAUGAUCCUAGCUAUCGUU | AACGAUAGCUAGGAUCAUCUU | 4345 |
| R-008398833-000J | 1803 | 1198 | GAUUGAUUCGAAAUCUUGC | GCAAGAUUUCGAAUCAAUCUU | 4347 |
| R-008398833-000J | 1803 | 1198 | GAUUGAUUCGAAAUCUUGC | B GAUUGAUUCGAAAUCUUGCTT B | 4346 |
| R-008398836-000K | 1701 | 1199 | CAGAGAUGGCCCAGAAUGC | B CAGAGAUGGCCCAGAAUGCTT B | 4348 |
| R-008398836-000K | 1701 | 1199 | CAGAGAUGGCCCAGAAUGC | GCAUUCUGGGCCAUCUCUGUU | 4349 |
| R-008398839-000L | 1910 | 1200 | CAGCGCCGUACGUCCAUGG | CCAUGGACGUACGGCGCUGUU | 4351 |
| R-008398839-000L | 1910 | 1200 | CAGCGCCGUACGUCCAUGG | B CAGCGCCGUACGUCCAUGGTT B | 4350 |
| R-008398842-000T | 888 | 1201 | AUGUAGAAACAGCUCGUUG | CAACGAGCUGUUUCUACAUU | 4353 |
| R-008398842-000T | 888 | 1201 | AUGUAGAAACAGCUCGUUG | B AUGUAGAAACAGCUCGUUGTT B | 4352 |
| R-008398845-000U | 1294 | 1202 | AGUGCUGAAGGUGCUAUCU | AGAUAGCACCUUCAGCACUUU | 4355 |
| R-008398845-000U | 1294 | 1202 | AGUGCUGAAGGUGCUAUCU | B AGUGCUGAAGGUGCUAUCUTT B | 4354 |
| R-008398848-000V | 1737 | 1203 | GACUACCAGUUGUGGUUAA | UUAACCACAACUGGUAGUCUU | 4357 |
| R-008398848-000V | 1737 | 1203 | GACUACCAGUUGUGGUUAA | B GACUACCAGUUGUGGUUAATT B | 4356 |
| R-008398851-000B | 1450 | 1204 | ACAGGAAGGGAUGGAAGGU | B ACAGGAAGGGAUGGAAGGUTT B | 4358 |
| R-008398851-000B | 1450 | 1204 | ACAGGAAGGGAUGGAAGGU | ACCUUCCAUCCCUUCCUGUUU | 4359 |
| R-008398854-000C | 761 | 1205 | CAGGUGGUGGUUAAUAAGG | C CUUAUUAACCACCACCUGUU | 4361 |
| R-008398854-000C | 761 | 1205 | CAGGUGGUGGUUAAUAAGG | B CAGGUGGUGGUUAAUAAGGTT B | 4360 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398857-000D | 776 | 1206 | AAGGCUGCAGUUAUGGUCC | B AAGGCUGCAGUUAUGGUCCTT B | 4362 |
| R-008398857-000D | 776 | 1206 | AAGGCUGCAGUUAUGGUCC | GGACCAUAACUGCAGCCUUUU | 4363 |
| R-008398860-000K | 1509 | 1207 | UAAAUGUGGUCACCUGUGC | GCACAGGUGACCACAUUUAUU | 4365 |
| R-008398860-000K | 1509 | 1207 | UAAAUGUGGUCACCUGUGC | B UAAAUGUGGUCACCUGUGCTT B | 4364 |
| R-008398863-000L | 1788 | 1208 | UAAAGGCUACUGUUGGAUU | B UAAAGGCUACUGUUGGAUUTT B | 4366 |
| R-008398863-000L | 1788 | 1208 | UAAAGGCUACUGUUGGAUU | AAUCCAACAGUAGCCUUUAUU | 4367 |
| R-008398866-000M | 515 | 1209 | GAUGGACAGUAUGCAAUGA | UCAUUGCAUACUGUCCAUCUU | 4369 |
| R-008398866-000M | 515 | 1209 | GAUGGACAGUAUGCAAUGA | B GAUGGACAGUAUGCAAUGATT B | 4368 |
| R-008398869-000N | 1491 | 1210 | UUCUGGGUUCAGAUGAUAU | B UUCUGGGUUCAGAUGAUAUTT B | 4370 |
| R-008398869-000N | 1491 | 1210 | UUCUGGGUUCAGAUGAUAU | AUAUCAUCUGAACCCAGAAUU | 4371 |
| R-008398872-000V | 1614 | 1211 | GUACUGUCCUUCGGGCUGG | B GUACUGUCCUUCGGGCUGGTT B | 4372 |
| R-008398872-000V | 1614 | 1211 | GUACUGUCCUUCGGGCUGG | CCAGCCCGAAGGACAGUACUU | 4373 |
| R-008398875-000W | 998 | 1212 | CUUGGUUCACCAGUGGAUU | B CUUGGUUCACCAGUGGAUUTT B | 4374 |
| R-008398875-000W | 998 | 1212 | CUUGGUUCACCAGUGGAUU | AAUCCACUGGUGAACCAAGUU | 4375 |
| R-008398878-000X | 2158 | 1213 | UAUUGAAGCUGAGGGAGCC | B UAUUGAAGCUGAGGGAGCCTT B | 4376 |
| R-008398878-000X | 2158 | 1213 | UAUUGAAGCUGAGGGAGCC | GGCUCCCUCAGCUUCAAUAUU | 4377 |
| R-008398881-000D | 3168 | 1214 | GUUGUUGUAACCUGCUGUG | B GUUGUUGUAACCUGCUGUGTT B | 4378 |
| R-008398881-000D | 3168 | 1214 | GUUGUUGUAACCUGCUGUG | CACAGCAGGUUACAACAACUU | 4379 |
| R-008398884-000E | 1854 | 1215 | AGCAGGGUGCCAUUCCACG | B AGCAGGGUGCCAUUCCACGTT B | 4380 |
| R-008398884-000E | 1854 | 1215 | AGCAGGGUGCCAUUCCACG | CGUGGAAUGGCACCCUGCUUU | 4381 |
| R-008398887-000F | 2117 | 1216 | GUCCUCUGUGAACUUGCUC | GAGCAAGUUCACAGAGGACUU | 4383 |
| R-008398887-000F | 2117 | 1216 | GUCCUCUGUGAACUUGCUC | B GUCCUCUGUGAACUUGCUCTT B | 4382 |
| R-008398890-000M | 1678 | 1217 | UCUGACCAGCCGACACCAA | UUGGUGUCGGCUGGUCAGAUU | 4385 |
| R-008398890-000M | 1678 | 1217 | UCUGACCAGCCGACACCAA | B UCUGACCAGCCGACACCAATT B | 4384 |
| R-008398893-000N | 2159 | 63 | AUUGAAGCUGAGGGAGCCA | B AUUGAAGCUGAGGGAGCCATT B | 4386 |
| R-008398893-000N | 2159 | 63 | AUUGAAGCUGAGGGAGCCA | UGGCUCCCUCAGCUUCAAUUU | 4387 |
| R-008398896-000P | 305 | 1218 | GCCAUGGAACCAGACAGAA | UUCUGUCUGGUUCCAUGGCUU | 4389 |
| R-008398896-000P | 305 | 1218 | GCCAUGGAACCAGACAGAA | B GCCAUGGAACCAGACAGAATT B | 4388 |
| R-008398899-000R | 2154 | 1219 | AAGCUAUUGAAGCUGAGGG | B AAGCUAUUGAAGCUGAGGGTT B | 4390 |
| R-008398899-000R | 2154 | 1219 | AAGCUAUUGAAGCUGAGGG | CCCUCAGCUUCAAUAGCUUUU | 4391 |
| R-008398902-000H | 1807 | 1220 | GAUUCGAAAUCUUGCCCUU | B GAUUCGAAAUCUUGCCCUUTT B | 4392 |
| R-008398902-000H | 1807 | 1220 | GAUUCGAAAUCUUGCCCUU | AAGGGCAAGAUUUCGAAUCUU | 4393 |
| R-008398905-000J | 1881 | 1221 | AGUUGCUUGUUCGUGCACA | B AGUUGCUUGUUCGUGCACATT B | 4394 |
| R-008398905-000J | 1881 | 1221 | AGUUGCUUGUUCGUGCACA | UGUGCACGAACAAGCAACUUU | 4395 |
| R-008398908-000K | 1565 | 1222 | AAGAACAAGAUGAUGGUCU | B AAGAACAAGAUGAUGGUCUTT B | 4396 |
| R-008398908-000K | 1565 | 1222 | AAGAACAAGAUGAUGGUCU | AGACCAUCAUCUUGUUCUUUU | 4397 |
| R-008398911-000S | 407 | 1223 | AGUGGUAAAGGCAAUCCUG | B AGUGGUAAAGGCAAUCCUGTT B | 4398 |
| R-008398911-000S | 407 | 1223 | AGUGGUAAAGGCAAUCCUG | CAGGAUUGCCUUUACCACUUU | 4399 |
| R-008398914-000T | 1434 | 1224 | CAGAUGCUGCAACUAAACA | UGUUUAGUUGCAGCAUCUGUU | 4401 |
| R-008398914-000T | 1434 | 1224 | CAGAUGCUGCAACUAAACA | B CAGAUGCUGCAACUAAACATT B | 4400 |
| R-008398917-000U | 566 | 1225 | CCUGAGACAUUAGAUGAGG | B CCUGAGACAUUAGAUGAGGTT B | 4402 |
| R-008398917-000U | 566 | 1225 | CCUGAGACAUUAGAUGAGG | CCUCAUCUAAUGUCUCAGGUU | 4403 |
| R-008398920-000A | 3161 | 1226 | UCCCAAAGUUGUUGUAACC | GGUUACAACAACUUUGGGAUU | 4405 |
| R-008398920-000A | 3161 | 1226 | UCCCAAAGUUGUUGUAACC | B UCCCAAAGUUGUUGUAACCTT B | 4404 |
| R-008398923-000B | 666 | 117 | AACAUGCAGUUGUAAACUU | AAGUUUACAACUGCAUGUUUU | 4407 |
| R-008398923-000B | 666 | 117 | AACAUGCAGUUGUAAACUU | B AACAUGCAGUUGUAAACUUTT B | 4406 |
| R-008398926-000C | 848 | 98 | AUGGUGUCUGCUAUUGUAC | GUACAAUAGCAGACACCAUUU | 4409 |
| R-008398926-000C | 848 | 98 | AUGGUGUCUGCUAUUGUAC | B AUGGUGUCUGCUAUUGUACTT B | 4408 |
| R-008398929-000D | 1679 | 1227 | CUGACCAGCCGACACCAAG | B CUGACCAGCCGACACCAAGTT B | 4410 |
| R-008398929-000D | 1679 | 1227 | CUGACCAGCCGACACCAAG | CUUGGUGUCGGCUGGUCAGUU | 4411 |
| R-008398932-000K | 2096 | 1228 | AUCCAAAGAGUAGCUGCAG | B AUCCAAAGAGUAGCUGCAGTT B | 4412 |
| R-008398932-000K | 2096 | 1228 | AUCCAAAGAGUAGCUGCAG | CUGCAGCUACUCUUUGGAUUU | 4413 |
| R-008398935-000L | 630 | 1229 | AUGUCCAGCGUUUGGCUGA | B AUGUCCAGCGUUUGGCUGATT B | 4414 |
| R-008398935-000L | 630 | 1229 | AUGUCCAGCGUUUGGCUGA | UCAGCCAAACGCUGGACAUUU | 4415 |
| R-008398938-000M | 1606 | 1230 | UCUUGUGCGUACUGUCCUU | AAGGACAGUACGCACAAGAUU | 4417 |
| R-008398938-000M | 1606 | 1230 | UCUUGUGCGUACUGUCCUU | B UCUUGUGCGUACUGUCCUUTT B | 4416 |
| R-008398941-000U | 432 | 1231 | AGGAUGUGGAUACCUCCA | UGGGAGGUAUCCACAUCCUUU | 4419 |
| R-008398941-000U | 432 | 1231 | AGGAUGUGGAUACCUCCA | B AGGAUGUGGAUACCUCCCATT B | 4418 |
| R-008398944-000V | 778 | 1232 | GGCUGCAGUUAUGGUCCAU | B GGCUGCAGUUAUGGUCCAUTT B | 4420 |
| R-008398944-000V | 778 | 1232 | GGCUGCAGUUAUGGUCCAU | AUGGACCAUAACUGCAGCCUU | 4421 |
| R-008398947-000W | 1999 | 1233 | UCACAUCCUAGCUCGGGAU | B UCACAUCCUAGCUCGGGAUTT B | 4422 |
| R-008398947-000W | 1999 | 1233 | UCACAUCCUAGCUCGGGAU | AUCCCGAGCUAGGAUGUGAUU | 4423 |
| R-008398950-000C | 1692 | 1234 | ACCAAGAAGCAGAGAUGGC | GCCAUCUCUGCUUCUUGGUUU | 4425 |
| R-008398950-000C | 1692 | 1234 | ACCAAGAAGCAGAGAUGGC | B ACCAAGAAGCAGAGAUGGCTT B | 4424 |
| R-008398953-000D | 2490 | 1235 | GCCACCACCUGGUGCUGA | B GCCACCACCUGGUGCUGATT B | 4426 |
| R-008398953-000D | 2490 | 1235 | GCCACCACCUGGUGCUGA | UCAGCACCAGGGUGGUGGCUU | 4427 |
| R-008398956-000E | 623 | 1236 | CCCACUAAUGUCCAGCGUU | AACGCUGGACAUUAGUGGGUU | 4429 |
| R-008398956-000E | 623 | 1236 | CCCACUAAUGUCCAGCGUU | B CCCACUAAUGUCCAGCGUUTT B | 4428 |
| R-008398959-000F | 339 | 1237 | ACUGGCAGCAACAGUCUUA | B ACUGGCAGCAACAGUCUUATT B | 4430 |
| R-008398959-000F | 339 | 1237 | ACUGGCAGCAACAGUCUUA | UAAGACUGUUGCUGCCAGUUU | 4431 |
| R-008398962-000M | 2471 | 166 | AUGGAACAUGAGAUGGGUG | CACCCAUCUCAUGUUCCAUUU | 4433 |
| R-008398962-000M | 2471 | 166 | AUGGAACAUGAGAUGGGUG | B AUGGAACAUGAGAUGGGUGTT B | 4432 |
| R-008398965-000N | 2037 | 164 | UCAGAGGACUAAAUACCAU | AUGGUAUUUAGUCCUCUGAUU | 4435 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008398965-000N | 2037 | 164 | UCAGAGGACUAAAUACCAU | B UCAGAGGACUAAAUACCAUTT B | 4434 |
| R-008398968-000P | 912 | 179 | CUGGGACCUUGCAUAACCU | AGGUUAUGCAAGGUCCCAGUU | 4437 |
| R-008398968-000P | 912 | 179 | CUGGGACCUUGCAUAACCU | B CUGGGACCUUGCAUAACCUTT B | 4436 |
| R-008398971-000W | 2946 | 1238 | AUCUGAAUAAAGUGUAACA | B AUCUGAAUAAAGUGUAACATT B | 4438 |
| R-008398971-000W | 2946 | 1238 | AUCUGAAUAAAGUGUAACA | UGUUACACUUUAUUCAGAUUU | 4439 |
| R-008398974-000X | 1654 | 1239 | GCCUGCCAUCUGUGCUCUU | AAGAGCACAGAUGGCAGGCUU | 4441 |
| R-008398974-000X | 1654 | 1239 | GCCUGCCAUCUGUGCUCUU | B GCCUGCCAUCUGUGCUCUUTT B | 4440 |
| R-008398977-000Y | 1033 | 1240 | CAUUACAACUCUCCACAAC | B CAUUACAACUCUCCACAACTT B | 4442 |
| R-008398977-000Y | 1033 | 1240 | CAUUACAACUCUCCACAAC | GUUGUGGAGAGUUGUAAUGUU | 4443 |
| R-008398980-000E | 840 | 1241 | CUCCUCAGAUGGUGUCUGC | GCAGACACCAUCUGAGGAGUU | 4445 |
| R-008398980-000E | 840 | 1241 | CUCCUCAGAUGGUGUCUGC | B CUCCUCAGAUGGUGUCUGCTT B | 4444 |
| R-008398983-000F | 1880 | 1242 | CAGUUGCUUGUUCGUGCAC | GUGCACGAACAAGCAACUGUU | 4447 |
| R-008398983-000F | 1880 | 1242 | CAGUUGCUUGUUCGUGCAC | B CAGUUGCUUGUUCGUGCACTT B | 4446 |
| R-008398986-000G | 420 | 1243 | AUCCUGAGGAAGAGGAUGU | B AUCCUGAGGAAGAGGAUGUTT B | 4448 |
| R-008398986-000G | 420 | 1243 | AUCCUGAGGAAGAGGAUGU | ACAUCCUCUUCCUCAGGAUUU | 4449 |
| R-008398989-000H | 1005 | 1244 | CACCAGUGGAUUCUGUGUU | B CACCAGUGGAUUCUGUGUUTT B | 4450 |
| R-008398989-000H | 1005 | 1244 | CACCAGUGGAUUCUGUGUU | AACACAGAAUCCACUGGUGUU | 4451 |
| R-008398992-000P | 1193 | 1245 | CAAGAAAGCAAGCUCAUCA | B CAAGAAAGCAAGCUCAUCATT B | 4452 |
| R-008398992-000P | 1193 | 1245 | CAAGAAAGCAAGCUCAUCA | UGAUGAGCUUGCUUUCUUGUU | 4453 |
| R-008398995-000R | 919 | 1246 | CUUGCAUAACCUUUCCCAU | AUGGGAAAGGUUAUGCAAGUU | 4455 |
| R-008398995-000R | 919 | 1246 | CUUGCAUAACCUUUCCCAU | B CUUGCAUAACCUUUCCCAUTT B | 4454 |
| R-008399001-000F | 1727 | 1247 | CUUCACUAUGGACUACCAG | CUGGUAGUCCAUAGUGAAGUU | 4457 |
| R-008399001-000F | 1727 | 1247 | CUUCACUAUGGACUACCAG | B CUUCACUAUGGACUACCAGTT B | 4456 |
| R-008399004-000G | 1883 | 1248 | UUGCUUGUUCGUGCACAUC | B UUGCUUGUUCGUGCACAUCTT B | 4458 |
| R-008399004-000G | 1883 | 1248 | UUGCUUGUUCGUGCACAUC | GAUGUGCACGAACAAGCAAUU | 4459 |
| R-008399007-000H | 859 | 1249 | UAUUGUACGUACCAUGCAG | B UAUUGUACGUACCAUGCAGTT B | 4460 |
| R-008399007-000H | 859 | 1249 | UAUUGUACGUACCAUGCAG | CUGCAUGGUACGUACAAUAUU | 4461 |
| R-008399010-000P | 870 | 57 | CCAUGCAGAAUACAAAUGA | B CCAUGCAGAAUACAAAUGATT B | 4462 |
| R-008399010-000P | 870 | 57 | CCAUGCAGAAUACAAAUGA | UCAUUUGUAUUCUGCAUGGUU | 4463 |
| R-008399013-000R | 1812 | 1250 | GAAAUCUUGCCCUUUUGUCC | GGACAAAGGGCAAGAUUUCUU | 4465 |
| R-008399013-000R | 1812 | 1250 | GAAAUCUUGCCCUUUUGUCC | B GAAAUCUUGCCCUUUGUCCTT B | 4464 |
| R-008399016-000S | 1605 | 1251 | CUCUUGUGCGUACUGUCCU | AGGACAGUAGCGCACAAGAGUU | 4467 |
| R-008399016-000S | 1605 | 1251 | CUCUUGUGCGUACUGUCCU | B CUCUUGUGCGUACUGUCCUTT B | 4466 |
| R-008399019-000T | 2021 | 1252 | CACAACCGAAUUGUUAUCA | UGAUAACAAUUCGGUUGUGUU | 4469 |
| R-008399019-000T | 2021 | 1252 | CACAACCGAAUUGUUAUCA | B CACAACCGAAUUGUUAUCATT B | 4468 |
| R-008399022-000Z | 2180 | 1253 | GCUCCUCUGACAGAGUUAC | GUAACUCUGUCAGAGGAGCUU | 4471 |
| R-008399022-000Z | 2180 | 1253 | GCUCCUCUGACAGAGUUAC | B GCUCCUCUGACAGAGUUACTT B | 4470 |
| R-008399025-000A | 636 | 1254 | AGCGUUUGGCUGAACCAUC | B AGCGUUUGGCUGAACCAUCTT B | 4472 |
| R-008399025-000A | 636 | 1254 | AGCGUUUGGCUGAACCAUC | GAUGGUUCAGCCAAACGCUUU | 4473 |
| R-008399031-000H | 871 | 48 | CAUGCAGAAUACAAAUGAU | B CAUGCAGAAUACAAAUGAUTT B | 4474 |
| R-008399031-000H | 871 | 48 | CAUGCAGAAUACAAAUGAU | AUCAUUUGUAUUCUGCAUGUU | 4475 |
| R-008399034-000J | 1801 | 96 | UGGAUUGAUUCGAAAUCUU | B UGGAUUGAUUCGAAAUCUUTT B | 4476 |
| R-008399034-000J | 1801 | 96 | UGGAUUGAUUCGAAAUCUU | AAGAUUUCGAAUCAAUCCAUU | 4477 |
| R-008399037-000K | 2282 | 1255 | AAACGGCUUUCAGUUGAGC | GCUCAACUGAAAGCCGUUUUU | 4479 |
| R-008399037-000K | 2282 | 1255 | AAACGGCUUUCAGUUGAGC | B AAACGGCUUUCAGUUGAGCTT B | 4478 |
| R-008399040-000S | 1824 | 1256 | UUUGUCCCGCAAAUCAUGC | GCAUGAUUUGCGGGACAAAUU | 4481 |
| R-008399040-000S | 1824 | 1256 | UUUGUCCCGCAAAUCAUGC | B UUUGUCCCGCAAAUCAUGCTT B | 4480 |
| R-008399043-000T | 2204 | 1257 | UCUAGGAAUGAAGGUGUGG | CCACACCUUCAUUCCUAGAUU | 4483 |
| R-008399043-000T | 2204 | 1257 | UCUAGGAAUGAAGGUGUGG | B UCUAGGAAUGAAGGUGUGGTT B | 4482 |
| R-008399046-000U | 450 | 1258 | AAGUCCUGUAUGAGUGGGA | B AAGUCCUGUAUGAGUGGGATT B | 4484 |
| R-008399046-000U | 450 | 1258 | AAGUCCUGUAUGAGUGGGA | UCCCACUCAUACAGGACUUUU | 4485 |
| R-008399049-000V | 1001 | 1259 | GGUUCACCAGUGGAUUCUG | B GGUUCACCAGUGGAUUCUGTT B | 4486 |
| R-008399049-000V | 1001 | 1259 | GGUUCACCAGUGGAUUCUG | CAGAAUCCACUGGUGAACCUU | 4487 |
| R-008399052-000B | 1579 | 1260 | GGUCUGCCAAGUGGGUGGU | ACCACCCACUUGGCAGACCUU | 4489 |
| R-008399052-000B | 1579 | 1260 | GGUCUGCCAAGUGGGUGGU | B GGUCUGCCAAGUGGGUGGUTT B | 4488 |
| R-008399055-000C | 2179 | 1261 | AGCUCCUCUGACAGAGUUA | UAACUCUGUCAGAGGAGCUUU | 4491 |
| R-008399055-000C | 2179 | 1261 | AGCUCCUCUGACAGAGUUA | B AGCUCCUCUGACAGAGUUATT B | 4490 |
| R-008399058-000D | 376 | 1262 | UUCUGGUGCCACUACCACA | B UUCUGGUGCCACUACCACATT B | 4492 |
| R-008399058-000D | 376 | 1262 | UUCUGGUGCCACUACCACA | UGUGGUAGUGGCACCAGAAUU | 4493 |
| R-008399061-000K | 556 | 1263 | UGCUAUGUUCCCUGAGACA | B UGCUAUGUUCCCUGAGACATT B | 4494 |
| R-008399061-000K | 556 | 1263 | UGCUAUGUUCCCUGAGACA | UGUCUCAGGGAACAUAGCAUU | 4495 |
| R-008399064-000L | 1804 | 1264 | AUUGAUUCGAAAUCUUGCC | B AUUGAUUCGAAAUCUUGCCTT B | 4496 |
| R-008399064-000L | 1804 | 1264 | AUUGAUUCGAAAUCUUGCC | GGCAAGAUUUCGAAUCAAUUU | 4497 |
| R-008399067-000M | 2552 | 1265 | CUCAUGGAUGGGCUGCCUC | B CUCAUGGAUGGGCUGCCUCTT B | 4498 |
| R-008399067-000M | 2552 | 1265 | CUCAUGGAUGGGCUGCCUC | GAGGCAGCCCAUCCAUGAGUU | 4499 |
| R-008399070-000U | 2071 | 1266 | GCUGCUUUAUUCUCCCAUU | B GCUGCUUUAUUCUCCCAUUTT B | 4500 |
| R-008399070-000U | 2071 | 1266 | GCUGCUUUAUUCUCCCAUU | AAUGGGAGAAUAAAGCAGCUU | 4501 |
| R-008399073-000V | 1145 | 16 | UUCUUGGCUAUUACGACAG | B UUCUUGGCUAUUACGACAGTT B | 4502 |
| R-008399073-000V | 1145 | 16 | UUCUUGGCUAUUACGACAG | CUGUCGUAAUAGCCAAGAAUU | 4503 |
| R-008399076-000W | 1836 | 1267 | AUCAUGCACCUUUGCGUGA | UCACGCAAAGGUGCAUGAUUU | 4505 |
| R-008399076-000W | 1836 | 1267 | AUCAUGCACCUUUGCGUGA | B AUCAUGCACCUUUGCGUGATT B | 4504 |
| R-008399079-000X | 336 | 1268 | GUCACUGGCAGCAACAGUC | B GUCACUGGCAGCAACAGUCTT B | 4506 |
| R-008399079-000X | 336 | 1268 | GUCACUGGCAGCAACAGUC | GACUGUUGCUGCCAGUGACUU | 4507 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008399082-000D | 460 | 1269 | UGAGUGGGAACAGGGAUUU | AAAUCCCUGUUCCCACUCAUU | 4509 |
| R-008399082-000D | 460 | 1269 | UGAGUGGGAACAGGGAUUU | B UGAGUGGGAACAGGGAUUUTT B | 4508 |
| R-008399085-000E | 1559 | 1270 | AAUUAUAAGAACAAGAUGA | B AAUUAUAAGAACAAGAUGATT B | 4510 |
| R-008399085-000E | 1559 | 1270 | AAUUAUAAGAACAAGAUGA | UCAUCUUGUUCUUAUAAUUUU | 4511 |
| R-008399091-000M | 3136 | 1271 | UGGACAGUUUACCAGUUGC | B UGGACAGUUUACCAGUUGCTT B | 4512 |
| R-008399091-000M | 3136 | 1271 | UGGACAGUUUACCAGUUGC | GCAACUGGUAAACUGUCCAUU | 4513 |
| R-008399097-000P | 1250 | 1272 | AUGAGGACCUAUACUUACG | B AUGAGGACCUAUACUUACGTT B | 4514 |
| R-008399097-000P | 1250 | 1272 | AUGAGGACCUAUACUUACG | CGUAAGUAUAGGUCCUCAUU | 4515 |
| R-008399100-000G | 1462 | 1273 | GGAAGGUCUCCUUGGGACU | B GGAAGGUCUCCUUGGGACUTT B | 4516 |
| R-008399100-000G | 1462 | 1273 | GGAAGGUCUCCUUGGGACU | AGUCCCAAGGAGACCUUCCUU | 4517 |
| R-008399103-000H | 1965 | 1274 | UGGAAGAAAUAGUUGAAGG | B UGGAAGAAAUAGUUGAAGGTT B | 4518 |
| R-008399103-000H | 1965 | 1274 | UGGAAGAAAUAGUUGAAGG | CCUUCAACUAUUUCUUCCAUU | 4519 |
| R-008399109-000K | 3114 | 1275 | GGUGUUAUUGGAACCUUG | CAAGGUUCCAAUAACACCUU | 4521 |
| R-008399109-000K | 3114 | 1275 | GGUGUUAUUGGAACCUUG | B GGUGUUAUUGGAACCUUGTT B | 4520 |
| R-008399112-000S | 1665 | 1276 | GUGCUCUUCGUCAUCUGAC | B GUGCUCUUCGUCAUCUGACTT B | 4522 |
| R-008399112-000S | 1665 | 1276 | GUGCUCUUCGUCAUCUGAC | GUCAGAUGACGAAGAGCACUU | 4523 |
| R-008399115-000T | 304 | 1277 | GGCCAUGGAACCAGACAGA | UCUGUCUGGUUCCAUGGCCUU | 4525 |
| R-008399115-000T | 304 | 1277 | GGCCAUGGAACCAGACAGA | B GGCCAUGGAACCAGACAGATT B | 4524 |
| R-008399118-000U | 327 | 1278 | CGGCUGUUAGUCACUGGCA | UGCCAGUGACUAACAGCCGUU | 4527 |
| R-008399118-000U | 327 | 1278 | CGGCUGUUAGUCACUGGCA | B CGGCUGUUAGUCACUGGCATT B | 4526 |
| R-008399121-000A | 1866 | 1279 | UUCCACGACUAGUUCAGUU | B UUCCACGACUAGUUCAGUUTT B | 4528 |
| R-008399121-000A | 1866 | 1279 | UUCCACGACUAGUUCAGUU | AACUGAACUAGUCGUGGAAUU | 4529 |
| R-008399124-000B | 1699 | 1280 | AGCAGAGAUGGCCCAGAAU | AUUCUGGGCCAUCUCUGCUUU | 4531 |
| R-008399124-000B | 1699 | 1280 | AGCAGAGAUGGCCCAGAAU | B AGCAGAGAUGGCCCAGAAUTT B | 4530 |
| R-008399127-000C | 2397 | 1281 | GCCAGGAUGAUCCUAGCUA | UAGCUAGGAUCAUCCUGGCUU | 4533 |
| R-008399127-000C | 2397 | 1281 | GCCAGGAUGAUCCUAGCUA | B GCCAGGAUGAUCCUAGCUATT B | 4532 |
| R-008399130-000J | 1658 | 1282 | GCCAUCUGUGCUCUUCGUC | B GCCAUCUGUGCUCUUCGUCTT B | 4534 |
| R-008399130-000J | 1658 | 1282 | GCCAUCUGUGCUCUUCGUC | GACGAAGAGCACAGAUGGCUU | 4535 |
| R-008399133-000K | 891 | 1283 | UAGAAACAGCUCGUUGUAC | GUACAACGAGCUGUUUCUAUU | 4537 |
| R-008399133-000K | 891 | 1283 | UAGAAACAGCUCGUUGUAC | B UAGAAACAGCUCGUUGUACTT B | 4536 |
| R-008399136-000L | 1572 | 1284 | AGAUGAUGGUCUGCCAAGU | B AGAUGAUGGUCUGCCAAGUTT B | 4538 |
| R-008399136-000L | 1572 | 1284 | AGAUGAUGGUCUGCCAAGU | ACUUGGCAGACCAUCAUCUUU | 4539 |
| R-008399139-000M | 927 | 1285 | ACCUUUCCCAUCAUCGUGA | B ACCUUUCCCAUCAUCGUGATT B | 4540 |
| R-008399139-000M | 927 | 1285 | ACCUUUCCCAUCAUCGUGA | UCACGAUGAUGGGAAAGGUUU | 4541 |
| R-008399142-000U | 290 | 1286 | AUGGAGUUGGACAUGGCCA | UGGCCAUGUCCAACUCCAUU | 4543 |
| R-008399142-000U | 290 | 1286 | AUGGAGUUGGACAUGGCCA | B AUGGAGUUGGACAUGGCCATT B | 4542 |
| R-008399145-000V | 1663 | 1287 | CUGUGCUCUUCGUCAUCUG | CAGAUGACGAAGAGCACAGUU | 4545 |
| R-008399145-000V | 1663 | 1287 | CUGUGCUCUUCGUCAUCUG | B CUGUGCUCUUCGUCAUCUGTT B | 4544 |
| R-008399148-000W | 1562 | 1288 | UAUAAGAACAAGAUGAUGG | B UAUAAGAACAAGAUGAUGGTT B | 4546 |
| R-008399148-000W | 1562 | 1288 | UAUAAGAACAAGAUGAUGG | CCAUCAUCUUGUUCUUAUAUU | 4547 |
| R-008399154-000D | 2947 | 1289 | UCUGAAUAAAGUGUAACAA | UUGUUACACUUUAUUCAGAUU | 4549 |
| R-008399154-000D | 2947 | 1289 | UCUGAAUAAAGUGUAACAA | B UCUGAAUAAAGUGUAACAATT B | 4548 |
| R-008399157-000E | 1711 | 1290 | CCAGAAUGCAGUUCGCCUU | AAGGCGAACUGCAUUCUGGUU | 4551 |
| R-008399157-000E | 1711 | 1290 | CCAGAAUGCAGUUCGCCUU | B CCAGAAUGCAGUUCGCCUUTT B | 4550 |
| R-008399160-000L | 1566 | 1291 | AGAACAAGAUGAUGGUCUG | B AGAACAAGAUGAUGGUCUGTT B | 4552 |
| R-008399160-000L | 1566 | 1291 | AGAACAAGAUGAUGGUCUG | CAGACCAUCAUCUUGUUCUUU | 4553 |
| R-008399163-000M | 1815 | 1292 | AUCUUGCCCUUUGUCCCGC | GCGGGACAAAGGGCAAGAUUU | 4555 |
| R-008399163-000M | 1815 | 1292 | AUCUUGCCCUUUGUCCCGC | B AUCUUGCCCUUUGUCCCGCTT B | 4554 |
| R-008399166-000N | 1087 | 1293 | GCGUUUAGCUGGUGGGCUG | CAGCCCACCAGCUAAACGCUU | 4557 |
| R-008399166-000N | 1087 | 1293 | GCGUUUAGCUGGUGGGCUG | B GCGUUUAGCUGGUGGGCUGTT B | 4556 |
| R-008399169-000P | 1495 | 1294 | GGGUUCAGAUGAUAUAAAU | B GGGUUCAGAUGAUAUAAAUTT B | 4558 |
| R-008399169-000P | 1495 | 1294 | GGGUUCAGAUGAUAUAAAU | AUUUAUAUCAUCUGAACCCUU | 4559 |
| R-008399172-000W | 1363 | 1295 | UUUAGGACUUCACCUGACA | B UUUAGGACUUCACCUGACATT B | 4560 |
| R-008399172-000W | 1363 | 1295 | UUUAGGACUUCACCUGACA | UGUCAGGUGAAGUCCUAAAUU | 4561 |
| R-008399175-000X | 391 | 1296 | CACAGCUCCUUCUCUGAGU | ACUCAGAGAAGGAGCUGUGUU | 4563 |
| R-008399175-000X | 391 | 1296 | CACAGCUCCUUCUCUGAGU | B CACAGCUCCUUCUCUGAGUTT B | 4562 |
| R-008399178-000Y | 1392 | 1297 | AACGUCUUGUUCAGAACUG | CAGUUCUGAACAAGACGUUUU | 4565 |
| R-008399178-000Y | 1392 | 1297 | AACGUCUUGUUCAGAACUG | B AACGUCUUGUUCAGAACUGTT B | 4564 |
| R-008399181-000E | 1935 | 1298 | CACAGCAGCAAUUUGUGGA | B CACAGCAGCAAUUUGUGGATT B | 4566 |
| R-008399181-000E | 1935 | 1298 | CACAGCAGCAAUUUGUGGA | UCCACAAAUUGCUGCUGUGUU | 4567 |
| R-008399184-000F | 1872 | 1299 | GACUAGUUCAGUUGCUUGU | B GACUAGUUCAGUUGCUUGUTT B | 4568 |
| R-008399184-000F | 1872 | 1299 | GACUAGUUCAGUUGCUUGU | ACAAGCAACUGAACUAGUCUU | 4569 |
| R-008399187-000G | 1159 | 1300 | GACAGACUGCCUUCAAAUU | AAUUUGAAGGCAGUCUGUCUU | 4571 |
| R-008399187-000G | 1159 | 1300 | GACAGACUGCCUUCAAAUU | B GACAGACUGCCUUCAAAUUTT B | 4570 |
| R-008399190-000N | 2308 | 1301 | CUCUCUCUUCAGAACAGAG | CUCUGUUCUGAAGAGAGAGUU | 4573 |
| R-008399190-000N | 2308 | 1301 | CUCUCUCUUCAGAACAGAG | B CUCUCUCUUCAGAACAGAGTT B | 4572 |
| R-008399193-000P | 632 | 1302 | GUCCAGCGUUUGGCUGAAC | GUUCAGCCAAACGCUGGACUU | 4575 |
| R-008399193-000P | 632 | 1302 | GUCCAGCGUUUGGCUGAAC | B GUCCAGCGUUUGGCUGAACTT B | 4574 |
| R-008399196-000R | 580 | 173 | UGAGGGCAUGCAGAUCCCA | B UGAGGGCAUGCAGAUCCCATT B | 4576 |
| R-008399196-000R | 580 | 173 | UGAGGGCAUGCAGAUCCCA | UGGGAUCUGCAUGCCCUCAUU | 4577 |
| R-008399199-000S | 1564 | 1303 | UAAGAACAAGAUGAUGGUC | B UAAGAACAAGAUGAUGGUCTT B | 4578 |
| R-008399199-000S | 1564 | 1303 | UAAGAACAAGAUGAUGGUC | GACCAUCAUCUUGUUCUUAUU | 4579 |
| R-008399202-000J | 1384 | 1304 | UCCAAGUCAACGUCUUGUU | B UCCAAGUCAACGUCUUGUUTT B | 4580 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008399202-000J | 1384 | 1304 | UCCAAGUCAACGUCUUGUU | AACAAGACGUUGACUUGGAUU | 4581 |
| R-008399205-000K | 1690 | 1305 | ACACCAAGAAGCAGAGAUG | B ACACCAAGAAGCAGAGAUGTT B | 4582 |
| R-008399205-000K | 1690 | 1305 | ACACCAAGAAGCAGAGAUG | CAUCUCUGCUUCUUGGUGUUU | 4583 |
| R-008399208-000L | 1421 | 1306 | CUCAGGAAUCUUUCAGAUG | B CUCAGGAAUCUUUCAGAUGTT B | 4584 |
| R-008399208-000L | 1421 | 1306 | CUCAGGAAUCUUUCAGAUG | CAUCUGAAAGAUUCCUGAGUU | 4585 |
| R-008399211-000T | 1141 | 1307 | UAAAUUCUUGGCUAUUACG | B UAAAUUCUUGGCUAUUACGTT B | 4586 |
| R-008399211-000T | 1141 | 1307 | UAAAUUCUUGGCUAUUACG | CGUAAUAGCCAAGAAUUUAUU | 4587 |
| R-008399214-000U | 1732 | 1308 | CUAUGGACUACCAGUUGUG | B CUAUGGACUACCAGUUGUGTT B | 4588 |
| R-008399214-000U | 1732 | 1308 | CUAUGGACUACCAGUUGUG | CACAACUGGUAGUCCAUAGUU | 4589 |
| R-008399217-000V | 634 | 1309 | CCAGCGUUUGGCUGAACCA | B CCAGCGUUUGGCUGAACCATT B | 4590 |
| R-008399217-000V | 634 | 1309 | CCAGCGUUUGGCUGAACCA | UGGUUCAGCCAAACGCUGGUU | 4591 |
| R-008399220-000B | 932 | 1310 | UCCCAUCAUCGUGAGGGCU | B UCCCAUCAUCGUGAGGGCUTT B | 4592 |
| R-008399220-000B | 932 | 1310 | UCCCAUCAUCGUGAGGGCU | AGCCCUCACGAUGAUGGGAUU | 4593 |
| R-008399223-000C | 579 | 171 | AUGAGGGCAUGCAGAUCCC | GGGAUCUGCAUGCCCUCAUU | 4595 |
| R-008399223-000C | 579 | 171 | AUGAGGGCAUGCAGAUCCC | B AUGAGGGCAUGCAGAUCCCTT B | 4594 |
| R-008399226-000D | 1366 | 1311 | AGGACUUCACCUGACAGAU | AUCUGUCAGGUGAAGUCCUUU | 4597 |
| R-008399226-000D | 1366 | 1311 | AGGACUUCACCUGACAGAU | B AGGACUUCACCUGACAGAUTT B | 4596 |
| R-008399229-000E | 1608 | 1312 | UUGUGCGUACUGUCCUUCG | B UUGUGCGUACUGUCCUUCGTT B | 4598 |
| R-008399229-000E | 1608 | 1312 | UUGUGCGUACUGUCCUUCG | CGAAGGACAGUACGCACAAUU | 4599 |
| R-008399232-000L | 814 | 10 | AGCUUCCAGACACGCUAUC | GAUAGCGUGUCUGGAAGCUUU | 4601 |
| R-008399232-000L | 814 | 10 | AGCUUCCAGACACGCUAUC | B AGCUUCCAGACACGCUAUCTT B | 4600 |
| R-008399235-000M | 1923 | 1313 | CCAUGGGUGGGACACAGCA | B CCAUGGGUGGGACACAGCATT B | 4602 |
| R-008399235-000M | 1923 | 1313 | CCAUGGGUGGGACACAGCA | UGCUGUGUCCCACCCAUGGUU | 4603 |
| R-008399238-000N | 1458 | 1314 | GGAUGGAAGGUCUCCUUGG | CCAAGGAGACCUUCCAUCCUU | 4605 |
| R-008399238-000N | 1458 | 1314 | GGAUGGAAGGUCUCCUUGG | B GGAUGGAAGGUCUCCUUGGTT B | 4604 |
| R-008399241-000V | 1908 | 1315 | CCCAGCGCCGUACGUCCAU | B CCCAGCGCCGUACGUCCAUTT B | 4606 |
| R-008399241-000V | 1908 | 1315 | CCCAGCGCCGUACGUCCAU | AUGGACGUACGGCGCUGGGUU | 4607 |
| R-008399244-000W | 539 | 1316 | GCUCAGAGGGUACGAGCUG | CAGCUCGUACCCUCUGAGCUU | 4609 |
| R-008399244-000W | 539 | 1316 | GCUCAGAGGGUACGAGCUG | B GCUCAGAGGGUACGAGCUGTT B | 4608 |
| R-008399247-000X | 2016 | 1317 | AUGUUCACAACCGAAUUGU | ACAAUUCGGUUGUGAACAUUU | 4611 |
| R-008399247-000X | 2016 | 1317 | AUGUUCACAACCGAAUUGU | B AUGUUCACAACCGAAUUGUTT B | 4610 |
| R-008399250-000D | 1884 | 1318 | UGCUUGUUCGUGCACAUCA | B UGCUUGUUCGUGCACAUCATT B | 4612 |
| R-008399250-000D | 1884 | 1318 | UGCUUGUUCGUGCACAUCA | UGAUGUGCACGAACAAGCAUU | 4613 |
| R-008399253-000E | 560 | 1319 | AUGUUCCCUGAGACAUUAG | B AUGUUCCCUGAGACAUUAGTT B | 4614 |
| R-008399253-000E | 560 | 1319 | AUGUUCCCUGAGACAUUAG | CUAAUGUCUCAGGGAACAUUU | 4615 |
| R-008399256-000F | 411 | 1320 | GUAAAGGCAAUCCUGAGGA | UCCUCAGGAUUGCCUUUACUU | 4617 |
| R-008399256-000F | 411 | 1320 | GUAAAGGCAAUCCUGAGGA | B GUAAAGGCAAUCCUGAGGATT B | 4616 |
| R-008399259-000G | 338 | 1321 | CACUGGCAGCAACAGUCUU | AAGACUGUUGCUGCCAGUGUU | 4619 |
| R-008399259-000G | 338 | 1321 | CACUGGCAGCAACAGUCUU | B CACUGGCAGCAACAGUCUUTT B | 4618 |
| R-008399262-000N | 830 | 1322 | AUCAUGCGUUCUCCUCAGA | UCUGAGGAGAACGCAUGAUUU | 4621 |
| R-008399262-000N | 830 | 1322 | AUCAUGCGUUCUCCUCAGA | B AUCAUGCGUUCUCCUCAGATT B | 4620 |
| R-008399265-000P | 3086 | 1323 | UAUGUAUGGGUAGGGUAAA | B UAUGUAUGGGUAGGGUAAATT B | 4622 |
| R-008399265-000P | 3086 | 1323 | UAUGUAUGGGUAGGGUAAA | UUUACCCUACCCAUACAUAUU | 4623 |
| R-008399268-000R | 3115 | 1324 | GUGUUAUUUGGAACCUUGU | ACAAGGUUCCAAAUAACACUU | 4625 |
| R-008399268-000R | 3115 | 1324 | GUGUUAUUUGGAACCUUGU | B GUGUUAUUUGGAACCUUGUTT B | 4624 |
| R-008399271-000X | 2177 | 1325 | ACAGCUCCUCUGACAGAGU | B ACAGCUCCUCUGACAGAGUTT B | 4626 |
| R-008399271-000X | 2177 | 1325 | ACAGCUCCUCUGACAGAGU | ACUCUGUCAGAGGAGCUGUUU | 4627 |
| R-008399274-000Y | 1733 | 1326 | UAUGGACUACCAGUUGUGG | B UAUGGACUACCAGUUGUGGTT B | 4628 |
| R-008399274-000Y | 1733 | 1326 | UAUGGACUACCAGUUGUGG | CCACAACUGGUAGUCCAUAUU | 4629 |
| R-008399277-000Z | 375 | 1327 | AUUCUGGUGCCACUACCAC | GUGGUAGUGGCACCAGAAUUU | 4631 |
| R-008399277-000Z | 375 | 1327 | AUUCUGGUGCCACUACCAC | B AUUCUGGUGCCACUACCACTT B | 4630 |
| R-008399280-000F | 2565 | 1328 | UGCCUCCAGGUGACAGCAA | B UGCCUCCAGGUGACAGCAATT B | 4632 |
| R-008399280-000F | 2565 | 1328 | UGCCUCCAGGUGACAGCAA | UUGCUGUCACCUGGAGGCAUU | 4633 |
| R-008399283-000G | 442 | 1329 | UACCUCCCAAGUCCUGUAU | AUACAGGACUUGGGAGGUAUU | 4635 |
| R-008399283-000G | 442 | 1329 | UACCUCCCAAGUCCUGUAU | B UACCUCCCAAGUCCUGUAUTT B | 4634 |
| R-008399286-000H | 819 | 1330 | CCAGACACGCUAUCAUGCG | CGCAUGAUAGCGUGUCUGGUU | 4637 |
| R-008399286-000H | 819 | 1330 | CCAGACACGCUAUCAUGCG | B CCAGACACGCUAUCAUGCGTT B | 4636 |
| R-008399289-000J | 700 | 1331 | UGAUGCAGAACUUGCCACA | B UGAUGCAGAACUUGCCACATT B | 4638 |
| R-008399289-000J | 700 | 1331 | UGAUGCAGAACUUGCCACA | UGUGGCAAGUUCUGCAUCAUU | 4639 |
| R-008399292-000R | 1089 | 1332 | GUUUAGCUGGUGGGCUGCA | B GUUUAGCUGGUGGGCUGCATT B | 4640 |
| R-008399292-000R | 1089 | 1332 | GUUUAGCUGGUGGGCUGCA | UGCAGCCCACCAGCUAAACUU | 4641 |
| R-008399295-000S | 1580 | 1333 | GUCUGCCAAGUGGGUGGUA | UACCACCCACUUGGCAGACUU | 4643 |
| R-008399295-000S | 1580 | 1333 | GUCUGCCAAGUGGGUGGUA | B GUCUGCCAAGUGGGUGGUATT B | 4642 |
| R-008399298-000T | 1982 | 1334 | GGUUGUACCGGAGCCCUUC | GAAGGGCUCCGGUACAACCUU | 4645 |
| R-008399298-000T | 1982 | 1334 | GGUUGUACCGGAGCCCUUC | B GGUUGUACCGGAGCCCUUCTT B | 4644 |
| R-008399301-000K | 1986 | 1335 | GUACCGGAGCCCUUCACAU | B GUACCGGAGCCCUUCACAUTT B | 4646 |
| R-008399301-000K | 1986 | 1335 | GUACCGGAGCCCUUCACAU | AUGUGAAGGGCUCCGGUACUU | 4647 |
| R-008399304-000L | 418 | 1336 | CAAUCCUGAGGAAGAGGAU | AUCCUCUUCCUCAGGAUUGUU | 4649 |
| R-008399304-000L | 418 | 1336 | CAAUCCUGAGGAAGAGGAU | B CAAUCCUGAGGAAGAGGAUTT B | 4648 |
| R-008399307-000M | 1306 | 1337 | GCUAUCUGUCUGCUCUAGU | ACUAGAGCAGACAGAUAGCUU | 4651 |
| R-008399307-000M | 1306 | 1337 | GCUAUCUGUCUGCUCUAGU | B GCUAUCUGUCUGCUCUAGUTT B | 4650 |
| R-008399310-000U | 1377 | 1338 | UGACAGAUCCAAGUCAACG | CGUUGACUUGGAUCUGUCAUU | 4653 |
| R-008399310-000U | 1377 | 1338 | UGACAGAUCCAAGUCAACG | B UGACAGAUCCAAGUCAACGTT B | 4652 |

TABLE 1c-continued

CTNNB1 siNA Strands Synthesized (Antisense sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008399313-000V | 2467 | 1339 | CAUGAUGGAACAUGAGAUG | CAUCUCAUGUUCCAUCAUGUU | 4655 |
| R-008399313-000V | 2467 | 1339 | CAUGAUGGAACAUGAGAUG | B CAUGAUGGAACAUGAGAUGTT B | 4654 |
| R-008399316-000W | 1414 | 1340 | UUGGACUCUCAGGAAUCUU | B UUGGACUCUCAGGAAUCUUTT B | 4656 |
| R-008399316-000W | 1414 | 1340 | UUGGACUCUCAGGAAUCUU | AAGAUUCCUGAGAGUCCAAUU | 4657 |
| R-008399319-000X | 1668 | 1341 | CUCUUCGUCAUCUGACCAG | B CUCUUCGUCAUCUGACCAGTT B | 4658 |
| R-008399319-000X | 1668 | 1341 | CUCUUCGUCAUCUGACCAG | CUGGUCAGAUGACGAAGAGUU | 4659 |
| R-008399322-000D | 1818 | 1342 | UUGCCCUUUGUCCCGCAAA | B UUGCCCUUUGUCCCGCAAATT B | 4660 |
| R-008399322-000D | 1818 | 1342 | UUGCCCUUUGUCCCGCAAA | UUUGCGGGACAAAGGGCAAUU | 4661 |
| R-008399325-000E | 1697 | 1343 | GAAGCAGAGAUGGCCCAGA | B GAAGCAGAGAUGGCCCAGATT B | 4662 |
| R-008399325-000E | 1697 | 1343 | GAAGCAGAGAUGGCCCAGA | UCUGGGCCAUCUCUGCUUCUU | 4663 |
| R-008399328-000F | 918 | 1344 | CCUUGCAUAACCUUUCCCA | B CCUUGCAUAACCUUUCCCATT B | 4664 |
| R-008399328-000F | 918 | 1344 | CCUUGCAUAACCUUUCCCA | UGGGAAAGGUUAUGCAAGGUU | 4665 |
| R-008399331-000M | 605 | 1345 | CAGUUUGAUGCUGCUCAUC | GAUGAGCAGCAUCAAACUGUU | 4667 |
| R-008399331-000M | 605 | 1345 | CAGUUUGAUGCUGCUCAUC | B CAGUUUGAUGCUGCUCAUCTT B | 4666 |
| R-008399334-000N | 1374 | 1346 | ACCUGACAGAUCCAAGUCA | B ACCUGACAGAUCCAAGUCATT B | 4668 |
| R-008399334-000N | 1374 | 1346 | ACCUGACAGAUCCAAGUCA | UGACUUGGAUCUGUCAGGUUU | 4669 |
| R-008399337-000P | 1430 | 1347 | CUUUCAGAUGCUGCAACUA | UAGUUGCAGCAUCUGAAAGUU | 4671 |
| R-008399337-000P | 1430 | 1347 | CUUUCAGAUGCUGCAACUA | B CUUUCAGAUGCUGCAACUATT B | 4670 |
| R-008399340-000W | 3186 | 1348 | GAUACGAUGCUUCAAGAGA | UCUCUUGAAGCAUCGUAUCUU | 4673 |
| R-008399340-000W | 3186 | 1348 | GAUACGAUGCUUCAAGAGA | B GAUACGAUGCUUCAAGAGATT B | 4672 |
| R-008399343-000X | 1355 | 1349 | AUGCAAGCUUUAGGACUUC | B AUGCAAGCUUUAGGACUUCTT B | 4674 |
| R-008399343-000X | 1355 | 1349 | AUGCAAGCUUUAGGACUUC | GAAGUCCUAAAGCUUGCAUUU | 4675 |
| R-008399346-000Y | 433 | 1350 | GGAUGUGGAUACCUCCCAA | UUGGGAGGUAUCCACAUCCUU | 4677 |
| R-008399346-000Y | 433 | 1350 | GGAUGUGGAUACCUCCCAA | B GGAUGUGGAUACCUCCCAATT B | 4676 |
| R-008399349-000Z | 1901 | 13 | CAGGAUACCCAGCGCCGUA | B CAGGAUACCCAGCGCCGUATT B | 4678 |
| R-008399349-000Z | 1901 | 13 | CAGGAUACCCAGCGCCGUA | UACGGCGCUGGGUAUCCUGUU | 4679 |
| R-008399352-000F | 1713 | 1351 | AGAAUGCAGUUCGCCUUCA | UGAAGGCGAACUGCAUUCUUU | 4681 |
| R-008399352-000F | 1713 | 1351 | AGAAUGCAGUUCGCCUUCA | B AGAAUGCAGUUCGCCUUCATT B | 4680 |
| R-008399355-000G | 823 | 17 | ACACGCUAUCAUGCGUUCU | AGAACGCAUGAUAGCGUGUUU | 4683 |
| R-008399355-000G | 823 | 17 | ACACGCUAUCAUGCGUUCU | B ACACGCUAUCAUGCGUUCUTT B | 4682 |
| R-008399358-000H | 1811 | 1352 | CGAAAUCUUGCCCUUUGUC | B CGAAAUCUUGCCCUUUGUCTT B | 4684 |
| R-008399358-000H | 1811 | 1352 | CGAAAUCUUGCCCUUUGUC | GACAAAGGGCAAGAUUUCGUU | 4685 |
| R-008399361-000P | 491 | 1353 | ACUCAAGAACAAGUAGCUG | B ACUCAAGAACAAGUAGCUGTT B | 4686 |
| R-008399361-000P | 491 | 1353 | ACUCAAGAACAAGUAGCUG | CAGCUACUUGUUCUUGAGUUU | 4687 |
| R-008399364-000R | 2209 | 1354 | GAAUGAAGGUGUGGCGACA | UGUCGCCACACCUUCAUUCUU | 4689 |
| R-008399364-000R | 2209 | 1354 | GAAUGAAGGUGUGGCGACA | B GAAUGAAGGUGUGGCGACATT B | 4688 |
| R-008399367-000S | 1840 | 1355 | UGCACCUUUGCGUGAGCAG | B UGCACCUUUGCGUGAGCAGTT B | 4690 |
| R-008399367-000S | 1840 | 1355 | UGCACCUUUGCGUGAGCAG | CUGCUCACGCAAAGGUGCAUU | 4691 |
| R-008399370-000Y | 550 | 1356 | ACGAGCUGCUAUGUUCCCU | AGGGAACAUAGCAGCUCGUUU | 4693 |
| R-008399370-000Y | 550 | 1356 | ACGAGCUGCUAUGUUCCCU | B ACGAGCUGCUAUGUUCCCUTT B | 4692 |
| R-008399373-000Z | 429 | 1357 | AAGAGGAUGUGGAUACCUC | GAGGUAUCCACAUCCUCUUUU | 4695 |
| R-008399373-000Z | 429 | 1357 | AAGAGGAUGUGGAUACCUC | B AAGAGGAUGUGGAUACCUCTT B | 4694 |
| R-008399376-000A | 2436 | 1358 | GAUAUGGCCAGGAUGCCUU | AAGGCAUCCUGGCCAUAUCUU | 4697 |
| R-008399376-000A | 2436 | 1358 | GAUAUGGCCAGGAUGCCUU | B GAUAUGGCCAGGAUGCCUUTT B | 4696 |
| R-008399379-000B | 1597 | 1359 | UAUAGAGGCUCUUGUGCGU | B UAUAGAGGCUCUUGUGCGUTT B | 4698 |
| R-008399379-000B | 1597 | 1359 | UAUAGAGGCUCUUGUGCGU | ACGCACAAGAGCCUCUAUAUU | 4699 |
| R-008399382-000H | 1496 | 1360 | GGUUCAGAUGAUAUAAAUG | B GGUUCAGAUGAUAUAAAUGTT B | 4700 |
| R-008399382-000H | 1496 | 1360 | GGUUCAGAUGAUAUAAAUG | CAUUUAUAUCAUCUGAACCUU | 4701 |
| R-008399385-000J | 1456 | 1361 | AGGGAUGGAAGGUCUCCUU | AAGGAGACCUUCCAUCCCUUU | 4703 |
| R-008399385-000J | 1456 | 1361 | AGGGAUGGAAGGUCUCCUU | B AGGGAUGGAAGGUCUCCUUTT B | 4702 |
| R-008399388-000K | 3159 | 1362 | UAUCCCAAAGUUGUUGUAA | UUACAACAACUUUGGGAUAUU | 4705 |
| R-008399388-000K | 3159 | 1362 | UAUCCCAAAGUUGUUGUAA | B UAUCCCAAAGUUGUUGUAATT B | 4704 |
| R-008399391-000S | 2309 | 1363 | UCUCUCUUCAGAACAGAGC | B UCUCUCUUCAGAACAGAGCTT B | 4706 |
| R-008399391-000S | 2309 | 1363 | UCUCUCUUCAGAACAGAGC | GCUCUGUUCUGAAGAGAGAUU | 4707 |
| R-008399394-000T | 2300 | 1364 | CUGACCAGCUCUCUCUUCA | B CUGACCAGCUCUCUCUUCATT B | 4708 |
| R-008399394-000T | 2300 | 1364 | CUGACCAGCUCUCUCUUCA | UGAAGAGAGAGCUGGUCAGUU | 4709 |
| R-008399397-000U | 3177 | 1365 | ACCUGCUGUGAUACGAUGC | B ACCUGCUGUGAUACGAUGCTT B | 4710 |
| R-008399397-000U | 3177 | 1365 | ACCUGCUGUGAUACGAUGC | GCAUCGUAUCACAGCAGGUUU | 4711 |
| R-008399400-000L | 1079 | 1366 | AUGGCAGUGCGUUUAGCUG | B AUGGCAGUGCGUUUAGCUGTT B | 4712 |
| R-008399400-000L | 1079 | 1366 | AUGGCAGUGCGUUUAGCUG | CAGCUAAACGCACUGCCAUUU | 4713 |
| R-008399403-000M | 1383 | 1367 | AUCCAAGUCAACGUCUUGU | ACAAGACGUUGACUUGGAUUU | 4715 |
| R-008399403-000M | 1383 | 1367 | AUCCAAGUCAACGUCUUGU | B AUCCAAGUCAACGUCUUGUTT B | 4714 |
| R-008399406-000N | 2563 | 1368 | GCUGCCUCCAGGUGACAGC | GCUGUCACCUGGAGGCAGCUU | 4717 |
| R-008399406-000N | 2563 | 1368 | GCUGCCUCCAGGUGACAGC | B GCUGCCUCCAGGUGACAGCTT B | 4716 |
| R-008399409-000P | 1084 | 1369 | AGUGCGUUUAGCUGGUGGG | B AGUGCGUUUAGCUGGUGGGTT B | 4718 |
| R-008399409-000P | 1084 | 1369 | AGUGCGUUUAGCUGGUGGG | CCCACCAGCUAAACGCACUUU | 4719 |
| R-008399412-000W | 1329 | 1370 | AGCCGGCUAUUGUAGAAGC | B AGCCGGCUAUUGUAGAAGCTT B | 4720 |
| R-008399412-000W | 1329 | 1370 | AGCCGGCUAUUGUAGAAGC | GCUUCUACAAUAGCCGGCUUU | 4721 |
| R-008399415-000X | 1662 | 169 | UCUGUGCUCUUCGUCAUCU | AGAUGACGAAGAGCACAGAUU | 4723 |
| R-008399415-000X | 1662 | 169 | UCUGUGCUCUUCGUCAUCU | B UCUGUGCUCUUCGUCAUCUTT B | 4722 |
| R-008399418-000Y | 2268 | 99 | CACAAGAUUACAAGAAACG | CGUUUCUUGUAAUCUUGUGUU | 4725 |
| R-008399418-000Y | 2268 | 99 | CACAAGAUUACAAGAAACG | B CACAAGAUUACAAGAAACGTT B | 4724 |
| R-008399421-000E | 2470 | 108 | GAUGGAACAUGAGAUGGGU | B GAUGGAACAUGAGAUGGGUTT B | 4726 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008399421-000E | 2470 | 108 | GAUGGAACAUGAGAUGGGU | ACCCAUCUCAUGUUCCAUCUU | 4727 |
| R-008399424-000F | 573 | 1371 | CAUUAGAUGAGGGCAUGCA | B CAUUAGAUGAGGGCAUGCATT B | 4728 |
| R-008399424-000F | 573 | 1371 | CAUUAGAUGAGGGCAUGCA | UGCAUGCCCUCAUCUAAUGUU | 4729 |
| R-008399427-000G | 2213 | 1372 | GAAGGUGUGGCGACAUAUG | B GAAGGUGUGGCGACAUAUGTT B | 4730 |
| R-008399427-000G | 2213 | 1372 | GAAGGUGUGGCGACAUAUG | CAUAUGUCGCCACACCUUCUU | 4731 |
| R-008399430-000N | 1587 | 1373 | AAGUGGGUGGUAUAGAGGC | B AAGUGGGUGGUAUAGAGGCTT B | 4732 |
| R-008399430-000N | 1587 | 1373 | AAGUGGGUGGUAUAGAGGC | GCCUCUAUACCACCCACUUUU | 4733 |
| R-008399433-000P | 2166 | 1374 | CUGAGGGAGCCACAGCUCC | B CUGAGGGAGCCACAGCUCCTT B | 4734 |
| R-008399433-000P | 2166 | 1374 | CUGAGGGAGCCACAGCUCC | GGAGCUGUGGCUCCCUCAGUU | 4735 |
| R-008399436-000R | 637 | 1375 | GCGUUUGGCUGAACCAUCA | UGAUGGUUCAGCCAAACGCUU | 4737 |
| R-008399436-000R | 637 | 1375 | GCGUUUGGCUGAACCAUCA | B GCGUUUGGCUGAACCAUCATT B | 4736 |
| R-008399439-000S | 397 | 1376 | UCCUUCUCUGAGUGGUAAA | B UCCUUCUCUGAGUGGUAAATT B | 4738 |
| R-008399439-000S | 397 | 1376 | UCCUUCUCUGAGUGGUAAA | UUUACCACUCAGAGAAGGAUU | 4739 |
| R-008399442-000Y | 1718 | 1377 | GCAGUUCGCCUUCACUAUG | B GCAGUUCGCCUUCACUAUGTT B | 4740 |
| R-008399442-000Y | 1718 | 1377 | GCAGUUCGCCUUCACUAUG | CAUAGUGAAGGCGAACUGCUU | 4741 |
| R-008399445-000Z | 1415 | 111 | UGGACUCUCAGGAAUCUUU | B UGGACUCUCAGGAAUCUUUTT B | 4742 |
| R-008399445-000Z | 1415 | 111 | UGGACUCUCAGGAAUCUUU | AAAGAUUCCUGAGAGUCCAUU | 4743 |
| R-008399448-000A | 1413 | 162 | UUUGGACUCUCAGGAAUCU | B UUUGGACUCUCAGGAAUCUTT B | 4744 |
| R-008399448-000A | 1413 | 162 | UUUGGACUCUCAGGAAUCU | AGAUUCCUGAGAGUCCAAAUU | 4745 |
| R-008399451-000G | 2445 | 160 | AGGAUGCCUUGGGUAUGGA | B AGGAUGCCUUGGGUAUGGATT B | 4746 |
| R-008399451-000G | 2445 | 160 | AGGAUGCCUUGGGUAUGGA | UCCAUACCCAAGGCAUCCUUU | 4747 |
| R-008399454-000H | 567 | 157 | CUGAGACAUUAGAUGAGGG | B CUGAGACAUUAGAUGAGGGTT B | 4748 |
| R-008399454-000H | 567 | 157 | CUGAGACAUUAGAUGAGGG | CCCUCAUCUAAUGUCUCAGUU | 4749 |
| R-008399457-000J | 1498 | 86 | UUCAGAUGAUAUAAAUGUG | CACAUUUAUAUCAUCUGAAUU | 4751 |
| R-008399457-000J | 1498 | 86 | UUCAGAUGAUAUAAAUGUG | B UUCAGAUGAUAUAAAUGUGTT B | 4750 |
| R-008399460-000R | 2357 | 1378 | GGACUUGAUAUUGGUGCCC | B GGACUUGAUAUUGGUGCCCTT B | 4752 |
| R-008399460-000R | 2357 | 1378 | GGACUUGAUAUUGGUGCCC | GGGCACCAAUAUCAAGUCCUU | 4753 |
| R-008399463-000S | 639 | 1379 | GUUUGGCUGAACCAUCACA | UGUGAUGGUUCAGCCAAACUU | 4755 |
| R-008399463-000S | 639 | 1379 | GUUUGGCUGAACCAUCACA | B GUUUGGCUGAACCAUCACATT B | 4754 |
| R-008399466-000T | 585 | 1380 | GCAUGCAGAUCCCAUCUAC | GUAGAUGGGAUCUGCAUGCUU | 4757 |
| R-008399466-000T | 585 | 1380 | GCAUGCAGAUCCCAUCUAC | B GCAUGCAGAUCCCAUCUACTT B | 4756 |
| R-008399469-000U | 2519 | 1381 | GAUGGGCUGCCAGAUCUGG | B GAUGGGCUGCCAGAUCUGGTT B | 4758 |
| R-008399469-000U | 2519 | 1381 | GAUGGGCUGCCAGAUCUGG | CCAGAUCUGGCAGCCCAUCUU | 4759 |
| R-008399472-000A | 1367 | 1382 | GGACUUCACCUGACAGAUC | B GGACUUCACCUGACAGAUCTT B | 4760 |
| R-008399472-000A | 1367 | 1382 | GGACUUCACCUGACAGAUC | GAUCUGUCAGGUGAAGUCCUU | 4761 |
| R-008399475-000B | 1391 | 1383 | CAACGUCUUGUUCAGAACU | B CAACGUCUUGUUCAGAACUTT B | 4762 |
| R-008399475-000B | 1391 | 1383 | CAACGUCUUGUUCAGAACU | AGUUCUGAACAAGACGUUGUU | 4763 |
| R-008399478-000C | 509 | 1384 | GAUAUUGAUGGACAGUAUG | B GAUAUUGAUGGACAGUAUGTT B | 4764 |
| R-008399478-000C | 509 | 1384 | GAUAUUGAUGGACAGUAUG | CAUACUGUCCAUCAAUAUCUU | 4765 |
| R-008399481-000J | 303 | 1385 | UGGCCAUGGAACCAGACAG | B UGGCCAUGGAACCAGACAGTT B | 4766 |
| R-008399481-000J | 303 | 1385 | UGGCCAUGGAACCAGACAG | CUGUCUGGUUCCAUGGCCAUU | 4767 |
| R-008399484-000K | 494 | 1386 | CAAGAACAAGUAGCUGAUA | UAUCAGCUACUUGUUCUUGUU | 4769 |
| R-008399484-000K | 494 | 1386 | CAAGAACAAGUAGCUGAUA | B CAAGAACAAGUAGCUGAUATT B | 4768 |
| R-008399487-000L | 328 | 1387 | GGCUGUUAGUCACUGGCAG | CUGCCAGUGACUAACAGCCUU | 4771 |
| R-008399487-000L | 328 | 1387 | GGCUGUUAGUCACUGGCAG | B GGCUGUUAGUCACUGGCAGTT B | 4770 |
| R-008399490-000T | 2058 | 1388 | CAUUGUUUGUGCAGCUGCU | AGCAGCUGCACAAACAAUGUU | 4773 |
| R-008399490-000T | 2058 | 1388 | CAUUGUUUGUGCAGCUGCU | B CAUUGUUUGUGCAGCUGCUTT B | 4772 |
| R-008399493-000U | 1447 | 1389 | UAAACAGGAAGGGAUGGAA | B UAAACAGGAAGGGAUGGAATT B | 4774 |
| R-008399493-000U | 1447 | 1389 | UAAACAGGAAGGGAUGGAA | UUCCAUCCCUUCCUGUUUAUU | 4775 |
| R-008399496-000V | 1563 | 1390 | AUAAGAACAAGAUGAUGGU | ACCAUCAUCUUGUUCUUAUUU | 4777 |
| R-008399496-000V | 1563 | 1390 | AUAAGAACAAGAUGAUGGU | B AUAAGAACAAGAUGAUGGUTT B | 4776 |
| R-008399499-000W | 1350 | 1391 | GUGGAAUGCAAGCUUUAGG | CCUAAAGCUUGCAUUCCACUU | 4779 |
| R-008399499-000W | 1350 | 1391 | GUGGAAUGCAAGCUUUAGG | B GUGGAAUGCAAGCUUUAGGTT B | 4778 |
| R-008399502-000N | 2208 | 1392 | GGAAUGAAGGUGUGGCGAC | GUCGCCACACCUUCAUUCCUU | 4781 |
| R-008399502-000N | 2208 | 1392 | GGAAUGAAGGUGUGGCGAC | B GGAAUGAAGGUGUGGCGACTT B | 4780 |
| R-008399505-000P | 1689 | 1393 | GACACCAAGAAGCAGAGAU | AUCUCUGCUUCUUGGUGUCUU | 4783 |
| R-008399505-000P | 1689 | 1393 | GACACCAAGAAGCAGAGAU | B GACACCAAGAAGCAGAGAUTT B | 4782 |
| R-008399508-000R | 1407 | 1394 | ACUGUCUUUGGACUCUCAG | B ACUGUCUUUGGACUCUCAGTT B | 4784 |
| R-008399508-000R | 1407 | 1394 | ACUGUCUUUGGACUCUCAG | CUGAGAGUCCAAAGACAGUUU | 4785 |
| R-008399511-000X | 2137 | 1395 | GGACAAGGAAGCUGCAGAA | B GGACAAGGAAGCUGCAGAATT B | 4786 |
| R-008399511-000X | 2137 | 1395 | GGACAAGGAAGCUGCAGAA | UUCUGCAGCUUCCUUGUCCUU | 4787 |
| R-008399514-000Y | 854 | 1396 | UCUGCUAUUGUACGUACCA | B UCUGCUAUUGUACGUACCATT B | 4788 |
| R-008399514-000Y | 854 | 1396 | UCUGCUAUUGUACGUACCA | UGGUACGUACAAUAGCAGAUU | 4789 |
| R-008399517-000Z | 2070 | 1397 | AGCUGCUUUAUUCUCCCAU | AUGGGAGAAUAAAGCAGCUUU | 4791 |
| R-008399517-000Z | 2070 | 1397 | AGCUGCUUUAUUCUCCCAU | B AGCUGCUUUAUUCUCCCAUTT B | 4790 |
| R-008399520-000F | 545 | 1398 | AGGGUACGAGCUGCUAUGU | ACAUAGCAGCUCGUACCCUU | 4793 |
| R-008399520-000F | 545 | 1398 | AGGGUACGAGCUGCUAUGU | B AGGGUACGAGCUGCUAUGUTT B | 4792 |
| R-008399523-000G | 1640 | 1399 | GAAGACAUCACUGAGCCUG | B GAAGACAUCACUGAGCCUGTT B | 4794 |
| R-008399523-000G | 1640 | 1399 | GAAGACAUCACUGAGCCUG | CAGGCUCAGUGAUGUCUUCUU | 4795 |
| R-008399526-000H | 2012 | 1400 | CGGGAUGUUCACAACCGAA | UUCGGUUGUGAACAUCCCGUU | 4797 |
| R-008399526-000H | 2012 | 1400 | CGGGAUGUUCACAACCGAA | B CGGGAUGUUCACAACCGAATT B | 4796 |
| R-008399529-000J | 1684 | 1401 | CAGCCGACACCAAGAAGCA | B CAGCCGACACCAAGAAGCATT B | 4798 |
| R-008399529-000J | 1684 | 1401 | CAGCCGACACCAAGAAGCA | UGCUUCUUGGUGUCGGCUGUU | 4799 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008399535-000S | 520 | 9 | ACAGUAUGCAAUGACUCGA | UCGAGUCAUUGCAUACUGUUU | 4801 |
| R-008399535-000S | 520 | 9 | ACAGUAUGCAAUGACUCGA | B ACAGUAUGCAAUGACUCGATT B | 4800 |
| R-008399538-000T | 1969 | 182 | AGAAAUAGUUGAAGGUUGU | B AGAAAUAGUUGAAGGUUGUTT B | 4802 |
| R-008399538-000T | 1969 | 182 | AGAAAUAGUUGAAGGUUGU | ACAACCUUCAACUAUUUCUUU | 4803 |
| R-008399541-000Z | 2017 | 1402 | UGUUCACAACCGAAUUGUU | B UGUUCACAACCGAAUUGUUTT B | 4804 |
| R-008399541-000Z | 2017 | 1402 | UGUUCACAACCGAAUUGUU | AACAAUUCGGUUGUGAACAUU | 4805 |
| R-008399544-000A | 2307 | 1403 | GCUCUCUCUUCAGAACAGA | B GCUCUCUCUUCAGAACAGATT B | 4806 |
| R-008399544-000A | 2307 | 1403 | GCUCUCUCUUCAGAACAGA | UCUGUUCUGAAGAGAGAGCUU | 4807 |
| R-008399547-000B | 844 | 1404 | UCAGAUGGUGUCUGCUAUU | B UCAGAUGGUGUCUGCUAUUTT B | 4808 |
| R-008399547-000B | 844 | 1404 | UCAGAUGGUGUCUGCUAUU | AAUAGCAGACACCAUCUGAUU | 4809 |
| R-008399550-000H | 405 | 1405 | UGAGUGGUAAAGGCAAUCC | GGAUUGCCUUUACCACUCAUU | 4811 |
| R-008399550-000H | 405 | 1405 | UGAGUGGUAAAGGCAAUCC | B UGAGUGGUAAAGGCAAUCCTT B | 4810 |
| R-008399553-000J | 379 | 1406 | UGGUGCCACUACCACAGCU | B UGGUGCCACUACCACAGCUTT B | 4812 |
| R-008399553-000J | 379 | 1406 | UGGUGCCACUACCACAGCU | AGCUGUGGUAGUGGCACCAUU | 4813 |
| R-008399556-000K | 1825 | 1407 | UUGUCCCGCAAAUCAUGCA | B UUGUCCCGCAAAUCAUGCATT B | 4814 |
| R-008399556-000K | 1825 | 1407 | UUGUCCCGCAAAUCAUGCA | UGCAUGAUUUGCGGGACAAUU | 4815 |
| R-008399559-000L | 2495 | 1408 | CACCCUGGUGCUGACUAUC | GAUAGUCAGCACCAGGGUGUU | 4817 |
| R-008399559-000L | 2495 | 1408 | CACCCUGGUGCUGACUAUC | B CACCCUGGUGCUGACUAUCTT B | 4816 |
| R-008399562-000T | 629 | 1409 | AAUGUCCAGCGUUUGGCUG | B AAUGUCCAGCGUUUGGCUGTT B | 4818 |
| R-008399562-000T | 629 | 1409 | AAUGUCCAGCGUUUGGCUG | CAGCCAAACGCUGGACAUUUU | 4819 |
| R-008399565-000U | 2561 | 1410 | GGGCUGCCUCCAGGUGACA | UGUCACCUGGAGGCAGCCCUU | 4821 |
| R-008399565-000U | 2561 | 1410 | GGGCUGCCUCCAGGUGACA | B GGGCUGCCUCCAGGUGACATT B | 4820 |
| R-008399568-000V | 2192 | 1411 | GAGUUACUUCACUCUAGGA | B GAGUUACUUCACUCUAGGATT B | 4822 |
| R-008399568-000V | 2192 | 1411 | GAGUUACUUCACUCUAGGA | UCCUAGAGUGAAGUAACUCUU | 4823 |
| R-008399571-000B | 1809 | 1412 | UUCGAAAUCUUGCCCUUUG | B UUCGAAAUCUUGCCCUUUGTT B | 4824 |
| R-008399571-000B | 1809 | 1412 | UUCGAAAUCUUGCCCUUUG | CAAAGGGCAAGAUUUCGAAUU | 4825 |
| R-008399574-000C | 1596 | 1413 | GUAUAGAGGCUCUUGUGCG | B GUAUAGAGGCUCUUGUGCGTT B | 4826 |
| R-008399574-000C | 1596 | 1413 | GUAUAGAGGCUCUUGUGCG | CGCACAAGAGCCUCUAUACUU | 4827 |
| R-008399577-000D | 2298 | 1414 | AGCUGACCAGCUCUCUCUU | AAGAGAGAGCUGGUCAGCUUU | 4829 |
| R-008399577-000D | 2298 | 1414 | AGCUGACCAGCUCUCUCUU | B AGCUGACCAGCUCUCUCUUTT B | 4828 |
| R-008399580-000K | 858 | 1415 | CUAUUGUACGUACCAUGCA | UGCAUGGUACGUACAAUAGUU | 4831 |
| R-008399580-000K | 858 | 1415 | CUAUUGUACGUACCAUGCA | B CUAUUGUACGUACCAUGCATT B | 4830 |
| R-008399583-000L | 524 | 1416 | UAUGCAAUGACUCGAGCUC | B UAUGCAAUGACUCGAGCUCTT B | 4832 |
| R-008399583-000L | 524 | 1416 | UAUGCAAUGACUCGAGCUC | GAGCUCGAGUCAUUGCAUAUU | 4833 |
| R-008399586-000M | 2542 | 1417 | UGCCCAGGACCUCAUGGAU | B UGCCCAGGACCUCAUGGAUTT B | 4834 |
| R-008399586-000M | 2542 | 1417 | UGCCCAGGACCUCAUGGAU | AUCCAUGAGGUCCUGGGCAUU | 4835 |
| R-008399589-000N | 498 | 1418 | AACAAGUAGCUGAUAUUGA | B AACAAGUAGCUGAUAUUGATT B | 4836 |
| R-008399589-000N | 498 | 1418 | AACAAGUAGCUGAUAUUGA | UCAAUAUCAGCUACUUGUUUU | 4837 |
| R-008399592-000V | 414 | 1419 | AAGGCAAUCCUGAGGAAGA | UCUUCCUCAGGAUUGCCUUUU | 4839 |
| R-008399592-000V | 414 | 1419 | AAGGCAAUCCUGAGGAAGA | B AAGGCAAUCCUGAGGAAGATT B | 4838 |
| R-008399595-000W | 1570 | 1420 | CAAGAUGAUGGUCUGCCAA | B CAAGAUGAUGGUCUGCCAATT B | 4840 |
| R-008399595-000W | 1570 | 1420 | CAAGAUGAUGGUCUGCCAA | UUGGCAGACCAUCAUCUUGUU | 4841 |
| R-008399598-000X | 1030 | 1421 | UGCCAUUACAACUCUCCAC | GUGGAGAGUUGUAAUGGCAUU | 4843 |
| R-008399598-000X | 1030 | 1421 | UGCCAUUACAACUCUCCAC | B UGCCAUUACAACUCUCCACTT B | 4842 |
| R-008399601-000P | 1380 | 20 | CAGAUCCAAGUCAACGUCU | AGACGUUGACUUGGAUCUGUU | 4845 |
| R-008399601-000P | 1380 | 20 | CAGAUCCAAGUCAACGUCU | B CAGAUCCAAGUCAACGUCUTT B | 4844 |
| R-008399604-000R | 3087 | 1422 | AUGUAUGGGUAGGGUAAAU | B AUGUAUGGGUAGGGUAAAUTT B | 4846 |
| R-008399604-000R | 3087 | 1422 | AUGUAUGGGUAGGGUAAAU | AUUUACCCUACCCAUACAUU | 4847 |
| R-008399607-000S | 1664 | 1423 | UGUGCUCUUCGUCAUCUGA | B UGUGCUCUUCGUCAUCUGATT B | 4848 |
| R-008399607-000S | 1664 | 1423 | UGUGCUCUUCGUCAUCUGA | UCAGAUGACGAAGAGCACAUU | 4849 |
| R-008399610-000Y | 1790 | 1424 | AAGGCUACUGUUGGAUUGA | B AAGGCUACUGUUGGAUUGATT B | 4850 |
| R-008399610-000Y | 1790 | 1424 | AAGGCUACUGUUGGAUUGA | UCAAUCCAACAGUAGCCUUUU | 4851 |
| R-008399613-000Z | 1615 | 1425 | UACUGUCCUUCGGGCUGGU | ACCAGCCCGAAGGACAGUAUU | 4853 |
| R-008399613-000Z | 1615 | 1425 | UACUGUCCUUCGGGCUGGU | B UACUGUCCUUCGGGCUGGUTT B | 4852 |
| R-008399616-000A | 774 | 1426 | AUAAGGCUGCAGUUAUGGU | ACCAUAACUGCAGCCUUAUUU | 4855 |
| R-008399616-000A | 774 | 1426 | AUAAGGCUGCAGUUAUGGU | B AUAAGGCUGCAGUUAUGGUTT B | 4854 |
| R-008399619-000B | 1672 | 1427 | UCGUCAUCUGACCAGCCGA | UCGGCUGGUCAGAUGACGAUU | 4857 |
| R-008399619-000B | 1672 | 1427 | UCGUCAUCUGACCAGCCGA | B UCGUCAUCUGACCAGCCGATT B | 4856 |
| R-008399625-000J | 3171 | 1428 | GUUGUAACCUGCUGUGAUA | UAUCACAGCAGGUUACAACUU | 4859 |
| R-008399625-000J | 3171 | 1428 | GUUGUAACCUGCUGUGAUA | B GUUGUAACCUGCUGUGAUATT B | 4858 |
| R-008399628-000K | 2271 | 1429 | AAGAUUACAAGAAACGGCU | B AAGAUUACAAGAAACGGCUTT B | 4860 |
| R-008399628-000K | 2271 | 1429 | AAGAUUACAAGAAACGGCU | AGCCGUUUCUUGUAAUCUUUU | 4861 |
| R-008399631-000S | 1183 | 1430 | UUAUGGCAACCAAGAAAGC | B UUAUGGCAACCAAGAAAGCTT B | 4862 |
| R-008399631-000S | 1183 | 1430 | UUAUGGCAACCAAGAAAGC | GCUUUCUUGGUUGCCAUAAUU | 4863 |
| R-008399634-000T | 2512 | 1431 | UCCAGUUGAUGGGCUGCCA | B UCCAGUUGAUGGGCUGCCATT B | 4864 |
| R-008399634-000T | 2512 | 1431 | UCCAGUUGAUGGGCUGCCA | UGGCAGCCCAUCAACUGGAUU | 4865 |
| R-008399637-000U | 1521 | 132 | CCUGUGCAGCUGGAAUUCU | AGAAUUCCAGCUGCACAGGUU | 4867 |
| R-008399637-000U | 1521 | 132 | CCUGUGCAGCUGGAAUUCU | B CCUGUGCAGCUGGAAUUCUTT B | 4866 |
| R-008399640-000A | 1931 | 1432 | GGGACACAGCAGCAAUUUG | CAAAUUGCUGCUGUGUCCCUU | 4869 |
| R-008399640-000A | 1931 | 1432 | GGGACACAGCAGCAAUUUG | B GGGACACAGCAGCAAUUUGTT B | 4868 |
| R-008399643-000B | 2468 | 1433 | AUGAUGGAACAUGAGAUGG | B AUGAUGGAACAUGAGAUGGTT B | 4870 |
| R-008399643-000B | 2468 | 1433 | AUGAUGGAACAUGAGAUGG | CCAUCUCAUGUUCCAUCAUUU | 4871 |
| R-008399646-000C | 3077 | 1434 | UAUUGGGGAUAUGUAUGGG | B UAUUGGGGAUAUGUAUGGGTT B | 4872 |

TABLE 1c-continued

CTNNB1 siNA Strands Synthesized (Antisense
sequences are readily identified as being complementary to the target sequence shown).

| R Number | Target Site (human) | SEQ ID NO: 1 | Target Sequence | Modified Sequence | SEQ ID NO: 2 |
|---|---|---|---|---|---|
| R-008399646-000C | 3077 | 1434 | UAUUUGGGAUAUGUAUGGG | CCCAUACAUAUCCCAAAUAUU | 4873 |
| R-008399649-000D | 2069 | 1435 | CAGCUGCUUUAUUCUCCCA | UGGGAGAAUAAAGCAGCUGUU | 4875 |
| R-008399649-000D | 2069 | 1435 | CAGCUGCUUUAUUCUCCCA | B CAGCUGCUUUAUUCUCCCATT B | 4874 |
| R-008399652-000K | 272 | 1436 | GCUACUCAAGCUGAUUUGA | B GCUACUCAAGCUGAUUUGATT B | 4876 |
| R-008399652-000K | 272 | 1436 | GCUACUCAAGCUGAUUUGA | UCAAAUCAGCUUGAGUAGCUU | 4877 |
| R-008399655-000L | 564 | 1437 | UCCCUGAGACAUUAGAUGA | UCAUCUAAUGUCUCAGGGAUU | 4879 |
| R-008399655-000L | 564 | 1437 | UCCCUGAGACAUUAGAUGA | B UCCCUGAGACAUUAGAUGATT B | 4878 |
| R-008399658-000M | 437 | 1438 | GUGGAUACCUCCCAAGUCC | GGACUUGGGAGGUAUCCACUU | 4881 |
| R-008399658-000M | 437 | 1438 | GUGGAUACCUCCCAAGUCC | B GUGGAUACCUCCCAAGUCCTT B | 4880 |
| R-008399661-000U | 2206 | 1439 | UAGGAAUGAAGGUGUGGCG | B UAGGAAUGAAGGUGUGGCGTT B | 4882 |
| R-008399661-000U | 2206 | 1439 | UAGGAAUGAAGGUGUGGCG | CGCCACACCUUCAUUCCUAUU | 4883 |
| R-008399664-000V | 2187 | 1440 | UGACAGAGUUACUUCACUC | GAGUGAAGUAACUCUGUCAUU | 4885 |
| R-008399664-000V | 2187 | 1440 | UGACAGAGUUACUUCACUC | B UGACAGAGUUACUUCACUCTT B | 4884 |
| R-008399667-000W | 325 | 1441 | AGCGGCUGUUAGUCACUGG | CCAGUGACUAACAGCCGCUUU | 4887 |
| R-008399667-000W | 325 | 1441 | AGCGGCUGUUAGUCACUGG | B AGCGGCUGUUAGUCACUGGTT B | 4886 |
| R-008399670-000C | 3222 | 1442 | AUGGUUCAGAAUUAAACUU | B AUGGUUCAGAAUUAAACUUTT B | 4888 |
| R-008399670-000C | 3222 | 1442 | AUGGUUCAGAAUUAAACUU | AAGUUUAAUUCUGAACCAUUU | 4889 |
| R-008399673-000D | 2024 | 1443 | AACCGAAUUGUUAUCAGAG | B AACCGAAUUGUUAUCAGAGTT B | 4890 |
| R-008399673-000D | 2024 | 1443 | AACCGAAUUGUUAUCAGAG | CUCUGAUAACAAUUCGGUUUU | 4891 |
| R-008399676-000E | 1858 | 1444 | GGGUGCCAUUCCACGACUA | B GGGUGCCAUUCCACGACUATT B | 4892 |
| R-008399676-000E | 1858 | 1444 | GGGUGCCAUUCCACGACUA | UAGUCGUGGAAUGGCACCCUU | 4893 |
| R-008399679-000F | 1574 | 1445 | AUGAUGGUCUGCCAAGUGG | B AUGAUGGUCUGCCAAGUGGTT B | 4894 |
| R-008399679-000F | 1574 | 1445 | AUGAUGGUCUGCCAAGUGG | CCACUUGGCAGACCAUCAUUU | 4895 |
| R-008399682-000M | 1638 | 78 | GGGAAGACAUCACUGAGCC | B GGGAAGACAUCACUGAGCCTT B | 4896 |
| R-008399682-000M | 1638 | 78 | GGGAAGACAUCACUGAGCC | GGCUCAGUGAUGUCUUCCCUU | 4897 |
| R-008399685-000N | 1896 | 1446 | CACAUCAGGAUACCCAGCG | B CACAUCAGGAUACCCAGCGTT B | 4898 |
| R-008399685-000N | 1896 | 1446 | CACAUCAGGAUACCCAGCG | CGCUGGGUAUCCUGAUGUGUU | 4899 |
| R-008399688-000P | 2207 | 1447 | AGGAAUGAAGGUGUGGCGA | B AGGAAUGAAGGUGUGGCGATT B | 4900 |
| R-008399688-000P | 2207 | 1447 | AGGAAUGAAGGUGUGGCGA | UCGCCACACCUUCAUUCCUUU | 4901 |
| R-008399691-000W | 1300 | 1448 | GAAGGUGCUAUCUGUCUGC | B GAAGGUGCUAUCUGUCUGCTT B | 4902 |
| R-008399691-000W | 1300 | 1448 | GAAGGUGCUAUCUGUCUGC | GCAGACAGAUAGCACCUUCUU | 4903 |
| R-008399694-000X | 1192 | 1449 | CCAAGAAAGCAAGCUCAUC | GAUGAGCUUGCUUUCUUGGUU | 4905 |
| R-008399694-000X | 1192 | 1449 | CCAAGAAAGCAAGCUCAUC | B CCAAGAAAGCAAGCUCAUCTT B | 4904 |
| R-008399697-000Y | 551 | 1450 | CGAGCUGCUAUGUUCCCUG | B CGAGCUGCUAUGUUCCCUGTT B | 4906 |
| R-008399697-000Y | 551 | 1450 | CGAGCUGCUAUGUUCCCUG | CAGGGAACAUAGCAGCUCGUU | 4907 |
| R-008399700-000R | 2498 | 1451 | CCUGGUGCUGACUAUCCAG | B CCUGGUGCUGACUAUCCAGTT B | 4908 |
| R-008399700-000R | 2498 | 1451 | CCUGGUGCUGACUAUCCAG | CUGGAUAGUCAGCACCAGGUU | 4909 |
| R-008399703-000S | 1305 | 1452 | UGCUAUCUGUCUGCUCUAG | B UGCUAUCUGUCUGCUCUAGTT B | 4910 |
| R-008399703-000S | 1305 | 1452 | UGCUAUCUGUCUGCUCUAG | CUAGAGCAGACAGAUAGCAUU | 4911 |
| R-008399706-000T | 1337 | 1453 | AUUGUAGAAGCUGGUGGAA | B AUUGUAGAAGCUGGUGGAATT B | 4912 |
| R-008399706-000T | 1337 | 1453 | AUUGUAGAAGCUGGUGGAA | UUCCACCAGCUUCUACAAUUU | 4913 |
| R-008472717-000G | 1870 | 194 | ACGACUAGUUCAGUUGCUU | aCgaCUAguUCAGUUGCUUUsU B | 2147 |
| R-008472717-000G | 1870 | 194 | ACGACUAGUUCAGUUGCUU | aaGCAAcUgAAcuagUCGUUsU | 6367 |
| R-008472765-000B | 1870 | 194 | ACGACUAGUUCAGUUGCUU | aaGCAAcUGAAcuaGUCGUUsU | 6368 |
| R-008472765-000B | 1870 | 194 | ACGACUAGUUCAGUUGCUU | B aCgaCUAguUCAGUUGCUUUsU B | 2147 |
| R-008488882-000B | 1797 | 5 | CUGUUGGAUUGAUUCGAAA | B CUGUUGGAUUGAUUCGAAAUU B | 6370 |
| R-008488882-000B | 1797 | 5 | CUGUUGGAUUGAUUCGAAA | uuucGAauCaAUCcAaCaGUU | 6369 |
| R-008488887-000V | 1870 | 194 | ACGACUAGUUCAGUUGCUU | aaGCAAcUgAaCuagUcGUUU | 6371 |
| R-008488887-000V | 1870 | 194 | ACGACUAGUUCAGUUGCUU | B aCgaCUAguUCAGUUGCUUUU B | 6372 |
| R-008488885-000C | 1870 | 194 | ACGACUAGUUCAGUUGCUU | aaGCAAcUgAAcuagUCGUUU | 6373 |
| R-008488885-000C | 1870 | 194 | ACGACUAGUUCAGUUGCUU | B aCgaCUAguUCAGUUGCUUUU B | 6372 |
| R-008488889-000M | 1870 | 194 | ACGACUAGUUCAGUUGCUU | B aCgaCUAguUCAGUUGCUUUU B | 6372 |
| R-008488889-000M | 1870 | 194 | ACGACUAGUUCAGUUGCUU | aaGCAAcUGAAcuaGUCGUUU | 6374 | wherein:

A, C, G, and U = ribose A, C, G or U a, g, c and u = 2'-deoxy-2'-fluoro A, G, C or U

*A*, *U*, *C* and *G* = 2'-O-methyl (2'-OMe) A, U, C, or G

*A*, *U*, *C*, and *G* = deoxy A, U, C, or G

B = inverted abasic

T = thymidine

I = inosine s = phosphorothioate linkage

Further Synthesis Steps for Commercial Preparation

Once analysis indicates that the target product purity has been achieved after the annealing step, the material is transferred to the tangential flow filtration (TFF) system for concentration and desalting, as opposed to doing this prior to the annealing step.

Ultrafiltration: The annealed product solution is concentrated using a TFF system containing an appropriate molecular weight cut-off membrane. Following concentration, the product solution is desalted via diafiltration using Milli-Q water until the conductivity of the filtrate is that of water.

Lyophilization: The concentrated solution is transferred to a bottle, flash frozen and attached to a lyophilizer. The product is then freeze-dried to a powder. The bottle is removed from the lyophilizer and is now ready for use.

Initial Screening Protocol (96-Well Plate Transfections)

Cell Culture Preparation:

Human hepatoma cell line, HepG2, rhesus kidney epithelial cell line, LLC-MK2 Derivative, and the Huh7 cell line, were grown in modified Eagle's medium. All the culture media were supplemented with 10% fetal bovine serum, 100 µg/mL streptomycin, 100 U/mL penicillin, and 1% sodium bicarbonate.

Transfection and Screening

Cells were plated in all wells of tissue-culture treated, 96-well plates at a final count of 3500 (HepG2 and LLC-MK2 Derivative and Huh7) cells/well in 100 µL of the appropriate culture media. The cells were cultured for overnight after plating at 37° C. in the presence of 5% $CO_2$.

On the next day, complexes containing siNA and RNAiMax (Invitrogen) were created as follows. A solution of RNAiMax diluted 33-fold in OPTI-MEM was prepared. In parallel, solutions of the siNAs for testing were prepared to a final concentration of 120 nM in OPTI-MEM. After incubation of RNAiMax/OPTI-MEM solution at room temperature for 5 min, an equal volume of the siNA solution and the RNAiMax solution were added together for each of the siNAs.

Mixing resulted in a solution of siNA/RNAiMax where the concentration of siNA was 60 nM. This solution was incubated at room temperature for 20 minutes. After incubation, 20 µL of the solution was added to each of the relevant wells. The final concentration of siNA in each well was 10 nM and the final volume of RNAiMax in each well was 0.3 ul.

For low concentration screens, siNAs were transfected at 200, 150, 100 or 75 pM per well. For 12-point dose response curve studies, the siNA series are 6-fold serial dilution starting at 30 nM or 4-fold serial dilution starting at 40 nM. All transfections were set up as multiple biological replicates.

The time of incubation with the RNAiMax-siNA complexes was 24 hours and there was no change in media between transfection and harvesting for screening and dose response curve studies. For duration assays, the time of incubation with the RNAiMax-siNA complexes was 24, 72, and 120 hours. There was no change in media between transfection and harvesting for 24- and 72-hour time points. Media was replaced with fresh media 72 hours after transfection for 120-hour time point.

Cells-to-Ct and Reverse Transcription Reactions

The culture medium was aspirated and discarded from the wells of the culture plates at the desired time points. The transfected cells were washed once with 50 uL DPBS solution per well. Fifty microliters per well of the Lysis Solution from the TaqMan® Gene Expression Cells-to-CT™ Kit (Applied Biosystems, Cat#4399002) supplemented with DNase I was added directly to the plates to lyse the cells. Five microliters per well of Stop Solution from the same kit was added to the plates to inactivate DNase 15 minutes later. The lysis plates were incubated for at least 2 minutes at room temperature. The plates can be stored for 2 hours at 4° C., or −80° C. for two months.

Each well of the reverse transcription plate required 10 uL of 2× reverse transcriptase buffer, 1 uL of 20× reverse transcription enzyme and 2 uL of nuclease-free water. The reverse transcription master mix was prepared by mixing 2× reverse transcription buffer, 20× reverse transcription enzyme mix, and nuclease-free water. 13 uL of the reverse transcription master mix was dispensed into each well of the reverse transcription plate (semi-skirted). A separate reverse transcription plate was prepared for each cell plate. A separate reverse transcription plate was prepared for each cell plate. Seven microliters per lysate from the cell lysis procedure described above was added into each well of the reverse transcription plate. The plate was sealed and spun on a centrifuge (1000 rpm for 30 seconds) to settle the contents to the bottom of the reverse transcription plate. The plate was placed in a thermocycler at 37° C. for 60 min, 95° C. for 5 min, and 4° C. until the plate is removed from the thermocycler. Upon removal, if not used immediately, the plate was frozen at −20° C.

For duration assays, a similar protocol was followed, however, the cells were lysed 1, 3, or 5 days after transfection. cDNA was generated using Cells-to-Ct™ Kit (Applied Biosystems).

Quantitative RT-PCR (Taqman)

A series of probes and primers were used to detect the various mRNA transcripts of the genes of CTNNB1 and GAPDH. All Taqman probes and primers for the experiments here-in described were supplied as pre-validated sets by Applied Biosystems, Inc. (see Table 2).

TABLE 2

Probes and primers used to carry out Real-Time RT/PCR (Taqman) reactions for CTNNB1 mRNA analysis.

| Species | Gene | ABI Cat. # |
|---|---|---|
| Human | CTNNB1 | Hs0035504_m1 |
| Human | GAPDH | 4310884E |
| Rhesus | GAPDH | Rh02621745_g1 |
| Mouse | CTNNB1 | Mm00483033_m1 |
| Mouse | GAPDH | 4352339E |

The assays were performed on an ABI 7900 instrument, according to the manufacturer's instructions. A TaqMan Gene Expression Master Mix (provided in the Cells-to-CT™ Kit, Applied Biosystems, Cat #4399002) was used. The PCR reactions were carried out at 50° C. for 2 min, 95° C. for 10 min followed by 40 cycles at 95° C. for 15 secs and 60° C. for 1 minute.

Within each experiment, the baseline was set in the exponential phase of the amplification curve, and based on the intersection point of the baselines with the amplification curve, a Ct value was assigned by the instrument.

Calculations

The expression level of the gene of interest and % inhibition of gene expression (% KD) was calculated using Comparative Ct method:

$$\Delta Ct = Ct_{Target} - Ct_{GAPDH}$$

$$\Delta\Delta Ct(\log 2(\text{fold change})) = \Delta Ct_{(Target\ siNA)} - \Delta Ct_{(NTC)}$$

$$\text{Relative expression level} = 2^{-\Delta\Delta Ct}$$

$$\% KD = 100 \times (1 - 2^{-\Delta\Delta Ct})$$

The non-targeting control siNA was, unless otherwise indicated, chosen as the value against which to calculate the percent inhibition (knockdown) of gene expression, because it is the most relevant control.

Additionally, only normalized data, which reflects the general health of the cell and quality of the RNA extraction, was examined. This was done by looking at the level of two different mRNAs in the treated cells, the first being the target mRNA and the second being the normalizer mRNA. This allowed for elimination of siNAs that might be potentially toxic to cells rather than solely knocking down the gene of interest. This was done by comparing the Ct for GAPDH in each well relative to the GAPDH Ct for the entire plate.

All calculations of $IC_{50}$s were performed using R.2.9.2 software. The data were analyzed using the sigmoidal dose-response (variable slope) equation for simple ligand binding. In all of the calculations of the percent inhibition (knockdown), the calculation was made relative to the normalized level of expression of the gene of interest in the samples treated with the non-targeting control (Ctrl siNA) unless otherwise indicated.

The level of protein was quantified using the Bio-Rad VersaDoc Imager according to the protocols of that piece of equipment. A pixel count was performed in each lane using an area of identical size. Each sample was then compared to the appropriate control treated sample and converted to a percent of protein remaining compared to control.

The effects of lead siNAs on CTNNB1 protein level were compared to the effects of the universal control using a two tail Student's T-test to obtain a P value. $P<0.05$ was considered significant.

Results:

The CTNNB1 siNAs were designed and synthesized as described previously. Various siNAs were screened in HepG2, MK2D and Huh7 cells. The log 2(fold change) in CTNNB1 gene expression data upon treatment with various modified CTNNB1 siNAs in human cells is shown in Table 3a. Each screen was performed at 24 hrs. Quantitative RT-PCR was used to assess the level of CTNNB1 mRNA and the data were normalized to the expression level of GAPDH (an ubiquitously expressed 'house-keeping' gene). Each treatment was then normalized against the non-CTNNB1 targeting control.

TABLE 3a

Primary screening data in HepG2 Cells, MK2D Cells and Huh7 Cells (n = 2), recorded as log 2(fold change) in CTNNB1 gene expression.

| siNA Duplex ID | HEPG2 Mean ΔΔCt | HEPG2 SD ΔΔCt | MK2D Mean ΔΔCt | MK2D SD ΔΔCt | Huh7 Mean ΔΔCt | Huh7 SD ΔΔCt |
| --- | --- | --- | --- | --- | --- | --- |
| R-008362875-000L | 5.06 | 0.28 | 5.05 | 0.05 | 4.10 | 0.12 |
| R-008362785-000U | 4.92 | 0.24 | 4.98 | 0.05 | 4.05 | 0.14 |
| R-008362959-000W | 4.76 | 0.11 | 4.90 | 0.14 | 3.99 | 0.05 |
| R-008363073-000K | 4.54 | 0.16 | 5.15 | 0.14 | 3.98 | 0.60 |
| R-008308997-000F | 4.27 | 0.32 | 4.86 | 0.17 | 3.97 | 0.16 |
| R-008362932-000A | 4.57 | 0.50 | 5.13 | 0.13 | 3.97 | 0.11 |
| R-008362713-000E | 4.52 | 0.02 | 4.56 | 0.00 | 3.96 | 0.20 |
| R-008362791-000B | 5.14 | 0.21 | 5.96 | 0.04 | 3.94 | 0.06 |
| R-008362689-000U | 5.16 | 0.20 | 5.24 | 0.04 | 3.94 | 0.08 |
| R-008362692-000A | 0.84 | 0.06 | 4.30 | 0.09 | 3.94 | 0.00 |
| R-008363055-000T | 4.87 | 0.16 | 5.19 | 0.11 | 3.86 | 0.13 |
| R-008309033-000Y | 4.39 | 0.08 | 5.35 | 0.15 | 3.83 | 0.04 |
| R-008363058-000U | 4.20 | 0.23 | 4.68 | 0.22 | 3.83 | 0.43 |
| R-008362755-000S | 4.18 | 0.21 | 4.37 | 0.08 | 3.83 | 0.10 |
| R-008362821-000P | 4.29 | 0.53 | 4.95 | 0.11 | 3.83 | 0.09 |
| R-008362722-000N | 5.37 | 0.36 | 5.27 | 0.19 | 3.82 | 0.25 |
| R-008362824-000R | 4.36 | 0.23 | 4.92 | 0.06 | 3.80 | 0.05 |
| R-008363070-000J | 4.51 | 0.03 | 4.54 | 0.01 | 3.79 | 0.14 |
| R-008362686-000T | 4.84 | 0.26 | 5.03 | 0.08 | 3.79 | 0.34 |
| R-008362947-000L | 4.45 | 0.25 | 4.74 | 0.04 | 3.79 | 0.44 |
| R-008362728-000R | 4.66 | 0.15 | 4.47 | 0.12 | 3.77 | 0.15 |
| R-008363019-000H | 4.75 | 0.08 | 5.06 | 0.05 | 3.77 | 0.21 |
| R-008362833-002Z | 4.26 | 0.11 | 4.61 | 0.15 | 3.75 | 0.09 |
| R-008362812-000F | 4.79 | 0.14 | 4.93 | 0.17 | 3.75 | 0.37 |
| R-008363064-000B | 4.54 | 0.11 | 4.87 | 0.16 | 3.75 | 0.49 |
| R-008362980-000V | 1.07 | 0.02 | 4.48 | 0.13 | 3.73 | 0.09 |
| R-008362992-000E | 0.35 | 0.09 | 4.24 | 0.04 | 3.72 | 0.00 |
| R-008362872-000K | 4.28 | 0.26 | 4.77 | 0.11 | 3.70 | 0.02 |
| R-008362677-000J | 4.37 | 0.06 | 4.60 | 0.01 | 3.68 | 0.08 |
| R-008362878-000M | 3.85 | 0.09 | 4.54 | 0.06 | 3.67 | 0.01 |
| R-008363031-000Y | 4.82 | 0.26 | 5.19 | 0.14 | 3.65 | 0.00 |
| R-008363043-000H | 4.89 | 0.27 | 5.61 | 0.03 | 3.65 | 0.04 |
| R-008362797-000D | 4.77 | 0.03 | 4.31 | 0.09 | 3.63 | 0.09 |
| R-008362842-000H | 3.92 | 0.00 | 4.71 | 0.09 | 3.63 | 0.26 |
| R-008362704-000W | 4.11 | 0.16 | 4.38 | 0.12 | 3.60 | 0.17 |
| R-008362740-000F | 0.66 | 0.11 | 4.74 | 0.10 | 3.60 | 0.00 |
| R-008362839-000B | 4.10 | 0.22 | 4.43 | 0.16 | 3.57 | 0.40 |
| R-008362950-000T | 4.73 | 0.08 | 4.80 | 0.21 | 3.55 | 0.03 |
| R-008363010-000E | 4.28 | 0.12 | 4.44 | 0.09 | 3.51 | 0.40 |
| R-008362752-000R | 3.42 | 0.03 | 2.93 | 0.04 | 3.50 | 0.33 |
| R-008362854-000T | 0.72 | 0.26 | 3.93 | 0.09 | 3.49 | 0.00 |
| R-008362830-000Y | 4.59 | 0.12 | 4.90 | 0.04 | 3.48 | 0.03 |
| R-008363016-000G | 4.14 | 0.09 | 4.35 | 0.02 | 3.45 | 0.05 |
| R-008362998-000G | 4.29 | 0.18 | 4.05 | 0.12 | 3.45 | 0.01 |
| R-008362674-000H | 4.55 | 0.14 | 4.55 | 0.01 | 3.45 | 0.32 |

TABLE 3a-continued

Primary screening data in HepG2 Cells, MK2D Cells and Huh7
Cells (n = 2), recorded as log 2(fold change) in CTNNB1 gene expression.

| siNA Duplex ID | HEPG2 Mean ΔΔCt | HEPG2 SD ΔΔCt | MK2D Mean ΔΔCt | MK2D SD ΔΔCt | Huh7 Mean ΔΔCt | Huh7 SD ΔΔCt |
| --- | --- | --- | --- | --- | --- | --- |
| R-008362938-000C | 4.27 | 0.10 | 5.01 | 0.22 | 3.44 | 0.27 |
| R-008362788-000V | 4.11 | 0.21 | 4.48 | 0.09 | 3.44 | 0.11 |
| R-008362884-000V | 4.11 | 0.08 | 4.90 | 0.13 | 3.44 | 0.11 |
| R-008362896-000E | 3.91 | 0.18 | 3.86 | 0.06 | 3.44 | 0.29 |
| R-008363061-000A | 3.84 | 0.17 | 4.34 | 0.01 | 3.43 | 0.14 |
| R-008362782-000T | 3.73 | 0.60 | 5.27 | 0.13 | 3.43 | 0.43 |
| R-008362776-000K | 4.08 | 0.15 | 4.33 | 0.15 | 3.43 | 0.12 |
| R-008362764-000A | 1.00 | 0.02 | 4.82 | 0.14 | 3.40 | 0.31 |
| R-008362683-000S | 0.85 | 0.00 | 4.80 | 0.12 | 3.39 | 0.32 |
| R-008362869-000D | 4.65 | 0.02 | 4.57 | 0.06 | 3.36 | 0.24 |
| R-008309054-000S | 0.88 | 0.01 | 4.27 | 0.08 | 3.36 | 0.12 |
| R-008362746-000H | 4.22 | 0.08 | 4.85 | 0.07 | 3.35 | 0.47 |
| R-008362935-000B | 4.51 | 0.01 | 5.00 | 0.14 | 3.33 | 0.15 |
| R-008362995-000F | 3.52 | 0.02 | 4.80 | 0.02 | 3.31 | 0.25 |
| R-008362923-000S | 4.16 | 0.16 | 4.15 | 0.08 | 3.31 | 0.09 |
| R-008309099-000E | 3.72 | 0.38 | 4.49 | 0.03 | 3.30 | 0.23 |
| R-008362794-000C | 3.97 | 0.05 | 3.81 | 0.05 | 3.30 | 0.12 |
| R-008308556-000N | 4.54 | 0.04 | 4.69 | 0.19 | 3.29 | 0.13 |
| R-008309087-000V | 4.04 | 0.06 | 4.19 | 0.14 | 3.28 | 0.01 |
| R-008362893-000D | 0.66 | 0.15 | 4.31 | 0.05 | 3.27 | 0.20 |
| R-008362725-000P | 4.20 | 0.22 | 4.54 | 0.23 | 3.26 | 0.05 |
| R-008362863-000B | 1.04 | 0.13 | 4.27 | 0.09 | 3.26 | 0.20 |
| R-008362941-000J | 3.93 | 0.42 | 4.38 | 0.16 | 3.24 | 0.34 |
| R-008362929-000U | 1.45 | 0.05 | 3.98 | 0.08 | 3.23 | 0.04 |
| R-008363052-000S | 0.43 | 0.13 | 4.30 | 0.07 | 3.23 | 0.03 |
| R-008362857-000U | 1.73 | 0.12 | 3.70 | 0.08 | 3.23 | 0.37 |
| R-008362758-000T | 0.70 | 0.16 | 4.19 | 0.10 | 3.22 | 0.41 |
| R-008309048-000J | 4.21 | 0.15 | 4.23 | 0.09 | 3.21 | 0.14 |
| R-008363004-000X | 3.76 | 0.12 | 4.55 | 0.07 | 3.20 | 0.43 |
| R-008362719-000G | 3.88 | 0.16 | 4.61 | 0.31 | 3.20 | 0.09 |
| R-008362671-000G | 4.56 | 0.19 | 4.71 | 0.19 | 3.20 | 0.06 |
| R-008363049-000K | 3.40 | 0.08 | 3.01 | 0.01 | 3.19 | 0.22 |
| R-008362902-000Y | 3.79 | 0.29 | 3.92 | 0.12 | 3.19 | 0.07 |
| R-008363022-000P | 4.32 | 0.21 | 4.06 | 0.12 | 3.14 | 0.43 |
| R-008362848-000K | 3.83 | 0.04 | 4.04 | 0.18 | 3.09 | 0.08 |
| R-008362743-000G | 4.46 | 0.16 | 5.28 | 0.10 | 3.09 | 0.69 |
| R-008362737-000Z | 4.41 | 0.09 | 4.88 | 0.24 | 3.09 | 0.19 |
| R-008362881-000U | 0.77 | 0.02 | 4.08 | 0.10 | 3.09 | 0.05 |
| R-008308601-000T | 4.21 | 0.54 | 4.56 | 0.02 | 3.08 | 0.17 |
| R-008362983-000W | 4.09 | 0.03 | 4.38 | 0.00 | 3.04 | 0.12 |
| R-008362800-000W | 4.42 | 0.15 | 4.69 | 0.06 | 3.02 | 0.38 |
| R-008362971-000L | 4.10 | 0.14 | 4.48 | 0.05 | 3.02 | 0.01 |
| R-008308661-000X | 3.68 | 0.27 | 4.68 | 0.21 | 3.00 | 0.09 |
| R-008362956-000V | 3.89 | 0.10 | 3.97 | 0.19 | 3.00 | 0.05 |
| R-008363001-000W | 3.97 | 0.05 | 4.25 | 0.06 | 2.99 | 0.02 |
| R-008362680-000R | 4.22 | 0.16 | 4.33 | 0.12 | 2.99 | 0.31 |
| R-008309081-000T | 3.97 | 0.11 | 4.21 | 0.01 | 2.99 | 0.35 |
| R-008362860-000A | 3.39 | 0.49 | 3.39 | 0.01 | 2.98 | 0.19 |
| R-008362716-000F | 3.87 | 0.10 | 4.27 | 0.19 | 2.96 | 0.20 |
| R-008362809-000Z | 0.82 | 0.00 | 3.79 | 0.06 | 2.95 | 0.18 |
| R-008308562-000W | 3.85 | 0.14 | 4.09 | 0.09 | 2.94 | 0.01 |
| R-008362989-000Y | 4.11 | 0.07 | 4.27 | 0.01 | 2.94 | 0.01 |
| R-008309102-000X | 3.95 | 0.05 | 3.89 | 0.20 | 2.90 | 0.11 |
| R-008362773-000J | 3.92 | 0.23 | 3.99 | 0.02 | 2.89 | 0.06 |
| R-008362779-000L | 4.30 | 0.20 | 4.46 | 0.02 | 2.85 | 0.86 |
| R-008362962-000C | 3.67 | 0.08 | 3.59 | 0.09 | 2.82 | 0.00 |
| R-008362905-000Z | 3.33 | 0.22 | 3.81 | 0.08 | 2.78 | 0.14 |
| R-008362707-000X | 3.53 | 0.49 | 4.13 | 0.15 | 2.78 | 0.03 |
| R-008362977-000N | 3.29 | 0.34 | 4.18 | 0.01 | 2.76 | 0.27 |
| R-008362944-000K | 3.56 | 0.19 | 3.31 | 0.13 | 2.75 | 0.19 |
| R-008309018-000G | 3.53 | 0.13 | 4.22 | 0.07 | 2.72 | 0.16 |
| R-008362770-000H | 3.92 | 0.15 | 3.97 | 0.01 | 2.72 | 0.12 |
| R-008362749-000J | 3.29 | 0.13 | 3.60 | 0.02 | 2.68 | 0.09 |
| R-008308496-000Y | 3.83 | 0.21 | 4.49 | 0.11 | 2.67 | 0.41 |
| R-008362836-000A | 0.49 | 0.02 | 3.94 | 0.05 | 2.67 | 0.81 |
| R-008308667-000Z | 4.42 | 0.01 | 4.60 | 0.03 | 2.65 | 0.45 |
| R-008362926-000T | 4.22 | 0.08 | 5.81 | 0.12 | 2.60 | 0.18 |
| R-008362851-000S | 4.01 | 0.80 | 4.57 | 0.01 | 2.53 | 0.95 |
| R-008363007-000Y | 3.23 | 0.05 | 2.93 | 0.15 | 2.51 | 0.19 |
| R-008362701-000V | 3.94 | 0.09 | 4.32 | 0.13 | 2.51 | 0.48 |
| R-008362698-000C | 4.10 | 0.03 | 4.15 | 0.13 | 2.50 | 0.24 |
| R-008308625-000M | 3.77 | 0.09 | 3.42 | 0.24 | 2.46 | 0.03 |
| R-008362815-000G | 4.27 | 0.20 | 4.14 | 0.09 | 2.46 | 0.51 |

TABLE 3a-continued

Primary screening data in HepG2 Cells, MK2D Cells and Huh7 Cells (n = 2), recorded as log 2(fold change) in CTNNB1 gene expression.

| siNA Duplex ID | HEPG2 Mean ΔΔCt | HEPG2 SD ΔΔCt | MK2D Mean ΔΔCt | MK2D SD ΔΔCt | Huh7 Mean ΔΔCt | Huh7 SD ΔΔCt |
|---|---|---|---|---|---|---|
| R-008363067-000C | 4.14 | 0.27 | 5.42 | 0.16 | 2.46 | 0.06 |
| R-008362914-000H | 3.78 | 0.03 | 3.66 | 0.06 | 2.41 | 0.25 |
| R-008363028-000S | 0.86 | 0.01 | 4.10 | 0.07 | 2.39 | 0.09 |
| R-008362866-000C | 3.42 | 0.03 | 3.68 | 0.01 | 2.38 | 0.07 |
| R-008362695-000B | 3.06 | 0.18 | 2.78 | 0.06 | 2.37 | 0.27 |
| R-008363013-000F | 3.56 | 0.24 | 3.93 | 0.11 | 2.37 | 0.16 |
| R-008362908-000A | 3.20 | 0.11 | 2.63 | 0.01 | 2.35 | 0.09 |
| R-008362917-000J | 3.01 | 0.04 | 3.23 | 0.05 | 2.34 | 0.15 |
| R-008308508-000U | 4.18 | 0.04 | 4.17 | 0.02 | 2.29 | 0.58 |
| R-008308526-000L | 0.59 | 0.04 | 3.87 | 0.09 | 2.27 | 0.15 |
| R-008363034-000Z | 0.78 | 0.17 | 3.95 | 0.02 | 2.27 | 0.30 |
| R-008362827-000S | 3.74 | 0.00 | 3.12 | 0.05 | 2.25 | 0.09 |
| R-008362968-000E | 4.00 | 0.02 | 3.46 | 0.12 | 2.24 | 0.62 |
| R-008309006-000X | 2.95 | 0.26 | 2.59 | 0.04 | 2.24 | 0.07 |
| R-008362734-000Y | 4.06 | 0.02 | 4.33 | 0.15 | 2.21 | 0.41 |
| R-008362767-000B | 4.22 | 0.05 | 4.19 | 0.13 | 2.13 | 0.41 |
| R-008362806-000Y | 0.73 | 0.04 | 2.89 | 0.02 | 2.08 | 0.56 |
| R-008308724-000N | 3.34 | 0.05 | 3.55 | 0.01 | 2.06 | 0.04 |
| R-008362818-000H | 1.49 | 0.14 | 3.44 | 0.05 | 2.05 | 0.18 |
| R-008309051-000R | 2.38 | 0.12 | 2.71 | 0.06 | 2.04 | 0.30 |
| R-008362920-000R | 2.82 | 0.31 | 3.00 | 0.13 | 1.98 | 0.03 |
| R-008362965-000D | 1.24 | 0.07 | 2.76 | 0.00 | 1.98 | 0.05 |
| R-008308544-000D | 0.53 | 0.03 | 3.67 | 0.07 | 1.97 | 0.04 |
| R-008308523-000K | 3.15 | 0.01 | 3.69 | 0.12 | 1.94 | 0.17 |
| R-008362986-000X | 3.24 | 0.08 | 3.50 | 0.13 | 1.92 | 0.01 |
| R-008362731-000X | 3.62 | 0.04 | 2.96 | 0.09 | 1.77 | 1.24 |
| R-008363046-000J | 2.67 | 0.02 | 3.94 | 0.05 | 1.75 | 0.07 |
| R-008308733-000X | 3.32 | 0.16 | 2.63 | 0.08 | 1.74 | 0.15 |
| R-008362911-000G | 0.75 | 0.04 | 2.74 | 0.10 | 1.73 | 0.26 |
| R-008308706-000W | 3.31 | 0.01 | 4.09 | 0.17 | 1.61 | 0.09 |
| R-008308709-000X | 3.29 | 0.13 | 3.95 | 0.00 | 1.54 | 0.30 |
| R-008362890-000C | 0.90 | 0.03 | 1.03 | 0.22 | 1.35 | 0.34 |
| R-008363025-000R | 2.95 | 0.06 | 3.05 | 0.08 | 1.32 | 0.81 |
| R-008362953-000U | 2.33 | 0.03 | 2.67 | 0.10 | 1.24 | 0.10 |
| R-008362899-000F | 1.50 | 0.17 | 2.77 | 0.03 | 1.24 | 0.13 |
| R-008308697-000B | 2.18 | 0.11 | 2.19 | 0.04 | 1.17 | 0.02 |
| R-008308589-000S | 2.17 | 0.22 | 3.42 | 0.03 | 1.12 | 0.08 |
| R-008308634-000W | 2.41 | 0.11 | 2.66 | 0.01 | 1.09 | 0.11 |
| R-008362710-000D | 0.71 | 0.10 | 2.17 | 0.11 | 1.06 | 0.18 |
| R-008308493-000X | 0.55 | 0.03 | 2.12 | 0.24 | 1.00 | 0.05 |
| R-008308703-000V | 0.87 | 0.02 | 1.69 | 0.02 | 0.95 | 0.13 |
| R-008308568-000Y | 2.84 | 0.14 | 2.85 | 0.23 | 0.63 | 0.41 |
| R-008362887-000W | 0.83 | 0.14 | 0.93 | 0.09 | 0.33 | 0.07 |
| R-008362974-000M | 0.80 | 0.07 | 0.96 | 0.02 | 0.23 | 0.02 |
| R-008363037-000A | 0.69 | 0.09 | 0.85 | 0.05 | 0.12 | 0.03 |
| R-008363040-000G | -0.07 | 0.02 | -0.22 | 0.05 | -0.19 | 0.09 |
| R-008362845-000J | -4.37 | 0.21 | -1.50 | 0.07 | -1.25 | 0.33 |
| R-008362761-000Z | -2.03 | 0.11 | -3.54 | 0.05 | -1.88 | 0.24 |
| R-008308586-000R | -1.64 | 0.18 | -1.83 | 0.01 | -2.27 | 0.31 |
| R-008362803-000X | -4.04 | 0.51 | -4.61 | 0.01 | -4.03 | 0.44 |

A subset of siNAs from Table 3a having a large log 2(fold change) in the primary screen were rescreened in Huh7 cells. The results are shown in Table 3b.

TABLE 3b

Primary screening data in Huh7 Cells (n = 2), recorded as log 2(fold change) in CTNNB1 gene expression.

| siNA Duplex ID | Huh7 Mean ΔΔCt | Huh7 SD ΔΔCt |
|---|---|---|
| R-008362791-000B | 4.24 | 0.05 |
| R-008362812-000F | 4.17 | 0.02 |
| R-008362689-000U | 4.17 | 0.01 |
| R-008362722-000N | 4.17 | 0.04 |
| R-008362932-000A | 4.07 | 0.17 |
| R-008363043-000H | 4.05 | 0.02 |
| R-008362875-000L | 4.03 | 0.12 |
| R-008308997-000F | 3.99 | 0.35 |
| R-008362947-000L | 3.99 | 0.18 |
| R-008362821-000P | 3.95 | 0.11 |
| R-008362686-000T | 3.94 | 0.13 |
| R-008363070-000J | 3.91 | 0.08 |
| R-008362824-000R | 3.91 | 0.16 |
| R-008362785-000U | 3.88 | 0.06 |
| R-008363031-000Y | 3.88 | 0.10 |
| R-008363073-000K | 3.87 | 0.19 |

TABLE 3b-continued

Primary screening data in Huh7 Cells (n = 2), recorded as log 2(fold change) in CTNNB1 gene expression.

| siNA Duplex ID | Huh7 Mean ΔΔCt | Huh7 SD ΔΔCt |
|---|---|---|
| R-008362782-000T | 3.86 | 0.04 |
| R-008309033-000Y | 3.85 | 0.00 |
| R-008363064-000B | 3.84 | 0.08 |
| R-008362950-000T | 3.84 | 0.05 |
| R-008362959-000W | 3.83 | 0.28 |
| R-008363019-000H | 3.82 | 0.02 |
| R-008362842-000H | 3.82 | 0.14 |
| R-008363058-000U | 3.75 | 0.11 |
| R-008362713-000E | 3.73 | 0.08 |
| R-008362938-000C | 3.72 | 0.05 |
| R-008362755-000S | 3.71 | 0.16 |
| R-008362746-000H | 3.59 | 0.22 |
| R-008362830-000Y | 3.56 | 0.16 |
| R-008362704-000W | 3.55 | 0.11 |
| R-008362839-000B | 3.48 | 0.23 |
| R-008362992-000E | 3.45 | 0.04 |
| R-008363055-000T | 3.44 | 0.26 |
| R-008363061-000A | 3.38 | 0.07 |
| R-008362995-000F | 3.35 | 0.01 |

The CTNNB1 siNAs were designed and synthesized as described previously. Various siNAs were screened in MK2D cells. The log 2(fold change) in CTNNB1 gene expression data upon treatment with various modified CTNNB1 siNAs in human cells is shown in Table 3c. Each screen was performed at 24 hrs. Quantitative RT-PCR was used to assess the level of CTNNB1 mRNA and the data were normalized to the expression level of GAPDH (a ubiquitously expressed 'house-keeping' gene). Each treatment was then normalized against the non-CTNNB1 targeting control.

TABLE 3c

Primary screening data in MK2D Cells (n = 2), recorded as log 2(fold change) in CTNNB1 gene expression.

| siNA Duplex ID | MK2D MEAN ΔΔCT | MK2D SD ΔΔCT |
|---|---|---|
| R-008395722-000P | 4.06 | 0.06 |
| R-008395725-000R | 3.78 | 0.08 |
| R-008395749-000K | 4.20 | 0.02 |
| R-008395752-000S | 5.53 | 0.06 |
| R-008395758-000U | 2.41 | 0.01 |
| R-008395761-000A | 5.61 | 0.08 |
| R-008395767-000C | 3.00 | 0.00 |
| R-008395770-000J | 5.53 | 0.18 |
| R-008395779-000M | 4.93 | 0.16 |
| R-008395785-000V | 2.56 | 0.19 |
| R-008395791-000C | 6.76 | 0.23 |
| R-008395800-000X | 2.87 | 0.07 |
| R-008395827-000T | 2.89 | 0.14 |
| R-008395863-000C | 1.65 | 0.22 |
| R-008395881-000V | 3.94 | 0.05 |
| R-008395887-000X | 4.54 | 0.24 |
| R-008395977-000P | 5.63 | 0.47 |
| R-008395980-000W | 4.31 | 0.27 |
| R-008395995-000G | 4.83 | 0.12 |
| R-008396004-000Y | 3.16 | 0.01 |
| R-008396022-000R | 4.83 | 0.13 |
| R-008396052-000T | 4.08 | 0.08 |
| R-008396061-000B | -0.99 | 0.08 |
| R-008396067-000D | 3.52 | 0.39 |
| R-008396070-000K | 4.84 | 0.03 |
| R-008396079-000N | 4.32 | 0.04 |
| R-008396103-000Z | 3.67 | 0.07 |
| R-008396106-000A | 5.34 | 0.03 |

TABLE 3c-continued

Primary screening data in MK2D Cells (n = 2), recorded as log 2(fold change) in CTNNB1 gene expression.

| siNA Duplex ID | MK2D MEAN ΔΔCT | MK2D SD ΔΔCT |
|---|---|---|
| R-008396109-000B | -1.10 | 0.03 |
| R-008396112-000H | 5.19 | 0.26 |
| R-008396118-000K | 3.23 | 0.01 |
| R-008396136-000C | -2.56 | |
| R-008396142-000K | -0.95 | 0.10 |
| R-008396148-000M | 3.84 | 0.24 |
| R-008396151-000U | 4.60 | 0.08 |
| R-008396154-000V | 4.77 | 0.07 |
| R-008396172-000M | 6.28 | 0.06 |
| R-008396214-000K | 2.82 | 0.29 |
| R-008396220-000T | 5.40 | 0.05 |
| R-008396223-000U | 4.57 | 0.06 |
| R-008396226-000V | 2.27 | 0.12 |
| R-008396247-000N | 3.32 | 0.08 |
| R-008396250-000V | 3.79 | 1.00 |
| R-008396253-000W | 6.42 | 0.03 |
| R-008396259-000Y | 2.14 | 0.03 |
| R-008396274-000P | 5.39 | 0.18 |
| R-008396292-000G | 3.85 | 0.05 |
| R-008396295-000H | 2.57 | 0.08 |
| R-008396298-000J | 3.00 | 0.22 |
| R-008396301-000B | 2.10 | 0.24 |
| R-008396304-000C | 3.24 | 0.04 |
| R-008396343-000N | 2.49 | 0.07 |
| R-008396349-000R | 4.00 | 0.08 |
| R-008396379-000T | 4.29 | 0.22 |
| R-008396382-000Z | -0.44 | 0.02 |
| R-008396388-000B | 3.90 | 0.18 |
| R-008396391-000H | 2.23 | 0.05 |
| R-008396409-000F | 3.96 | 0.26 |
| R-008396415-000N | 4.72 | 0.00 |
| R-008396418-000P | 4.48 | 0.20 |
| R-008396421-000W | 3.78 | 0.14 |
| R-008396457-000A | 3.89 | 0.01 |
| R-008396478-000U | 4.62 | 0.03 |
| R-008396481-000A | 4.29 | 0.14 |
| R-008396529-000A | 4.69 | 0.10 |
| R-008396532-000G | 4.46 | 0.05 |
| R-008396538-000J | 5.59 | 0.05 |
| R-008396544-000S | 5.04 | 0.20 |
| R-008396550-000Z | 3.79 | 0.18 |
| R-008396553-000A | 2.32 | 0.01 |
| R-008396556-000B | 2.85 | 0.07 |
| R-008396559-000C | 5.20 | 0.12 |
| R-008396613-000R | 4.92 | 0.10 |
| R-008396616-000S | 2.90 | 0.01 |
| R-008396619-000T | 4.67 | 0.37 |
| R-008396622-000Z | 4.09 | 0.08 |
| R-008396631-000H | 4.28 | 0.13 |
| R-008396685-000E | 4.01 | 0.10 |
| R-008396694-000N | 4.73 | 0.12 |
| R-008396697-000P | 1.56 | 0.16 |
| R-008396730-000J | 2.19 | 0.02 |
| R-008396730-000J | 3.24 | 0.03 |
| R-008396733-000K | 1.43 | 0.10 |
| R-008396736-000L | 5.14 | 0.04 |
| R-008396742-000U | 0.78 | 0.28 |
| R-008396751-000C | 3.62 | 0.13 |
| R-008396754-000D | 4.17 | 0.05 |
| R-008396793-000P | 2.68 | 0.01 |
| R-008396796-000R | 4.94 | 0.03 |
| R-008396820-000B | 4.70 | 0.08 |
| R-008396826-000D | 4.73 | 0.20 |
| R-008396832-000L | 3.63 | 0.10 |
| R-008396835-000M | 2.84 | 0.85 |
| R-008396838-000N | 3.40 | 0.20 |
| R-008396868-000R | 3.99 | 0.14 |
| R-008396871-000X | 4.62 | 0.12 |
| R-008396874-000Y | 4.01 | 0.02 |
| R-008396898-000T | 3.11 | 0.32 |
| R-008396904-000L | 2.46 | 0.06 |
| R-008396910-000U | 2.30 | 0.03 |

TABLE 3c-continued

Primary screening data in MK2D Cells (n =2), recorded as log 2(fold change) in CTNNB1 gene expression.

| siNA Duplex ID | MK2D MEAN ΔΔCT | MK2D SD ΔΔCT |
|---|---|---|
| R-008396919-000X | 4.06 | 0.23 |
| R-008396934-000N | 3.37 | 0.18 |
| R-008396943-000X | 3.77 | 0.01 |
| R-008396949-000Z | 3.40 | 0.07 |
| R-008396958-000H | 5.29 | 0.05 |
| R-008396985-000J | 5.25 | 0.09 |
| R-008396994-000T | 3.08 | 0.40 |
| R-008397015-000U | 4.41 | 0.08 |
| R-008397018-000V | 1.73 | 0.03 |
| R-008397021-000B | 5.50 | 0.05 |
| R-008397024-000C | 3.45 | 0.27 |
| R-008397039-000N | 4.21 | 0.04 |
| R-008397060-000M | 1.76 | 0.08 |
| R-008397069-000R | 3.16 | 0.14 |
| R-008397072-000X | 3.94 | 0.17 |
| R-008397081-000F | 3.02 | 0.02 |
| R-008397108-000M | 5.62 | 0.08 |
| R-008397111-000U | 4.08 | 0.10 |
| R-008397114-000V | 3.50 | 0.03 |
| R-008397132-000M | 3.97 | 0.16 |
| R-008397138-000P | 6.60 | 0.17 |
| R-008397141-000W | 4.58 | 0.02 |
| R-008397147-000Y | 3.73 | 0.00 |
| R-008397150-000E | 6.44 | 0.11 |
| R-008397153-000F | 2.43 | 0.03 |
| R-008397156-000G | 4.04 | 0.31 |
| R-008397165-000R | 3.44 | 0.01 |
| R-008397168-000S | 3.29 | 0.15 |
| R-008397180-000G | 4.46 | 0.02 |
| R-008397186-000J | 5.22 | 0.06 |
| R-008397237-000R | 2.77 | 0.04 |
| R-008397243-000Y | 3.31 | 0.23 |
| R-008397246-000Z | 3.21 | 0.21 |
| R-008397255-000H | 3.77 | 0.05 |
| R-008397258-000J | 1.91 | 0.02 |
| R-008397306-000P | 3.04 | 0.05 |
| R-008397309-000R | 3.16 | 0.05 |
| R-008397312-000X | 5.97 | 0.13 |
| R-008397315-000Y | 4.19 | 0.33 |
| R-008397342-000Z | 3.04 | 0.06 |
| R-008397345-000A | 4.87 | 0.03 |
| R-008397348-000B | 3.62 | 0.04 |
| R-008397351-000H | 2.29 | 0.15 |
| R-008397354-000J | 4.81 | 0.09 |
| R-008397372-000B | 4.40 | 0.10 |
| R-008397381-000K | 3.38 | 0.08 |
| R-008397384-000L | 3.95 | 0.14 |
| R-008397387-000M | 6.11 | 0.04 |
| R-008397390-000U | 3.84 | 0.16 |
| R-008397396-000W | 6.69 | 0.24 |
| R-008397408-000S | 5.61 | 0.05 |
| R-008397417-000A | 3.92 | 0.49 |
| R-008397420-000G | 4.53 | 0.02 |
| R-008397429-000K | 2.91 | 0.05 |
| R-008397450-000J | 2.53 | 0.05 |
| R-008397459-000M | 4.75 | 0.00 |
| R-008397462-000U | 5.28 | 0.17 |
| R-008397465-000V | 4.45 | 0.18 |
| R-008397468-000W | 4.05 | 0.09 |
| R-008397471-000C | 3.22 | 0.12 |
| R-008397474-000D | 4.06 | 0.21 |
| R-008397519-000C | 3.67 | 0.03 |
| R-008397531-000T | 5.94 | 0.10 |
| R-008397537-000V | 4.20 | 0.07 |
| R-008397540-000B | 5.04 | 0.12 |
| R-008397564-000W | 5.95 | 0.12 |
| R-008397576-000F | 3.39 | 0.05 |
| R-008397579-000G | 2.94 | 0.02 |
| R-008397582-000N | 3.95 | 0.12 |
| R-008397588-000R | 4.25 | 0.07 |
| R-008397591-000X | 5.25 | 0.06 |
| R-008397594-000Y | 3.81 | 0.00 |
| R-008397618-000D | 4.58 | 0.03 |
| R-008397630-000U | 3.46 | 0.15 |
| R-008397645-000E | 3.71 | 0.07 |
| R-008397657-000P | −1.50 | 0.14 |
| R-008397660-000W | 4.85 | 0.04 |
| R-008397663-000X | 2.62 | 0.03 |
| R-008397666-000Y | 3.68 | 0.09 |
| R-008397669-000Z | 2.80 | 0.78 |
| R-008397702-000U | 2.34 | 0.78 |
| R-008397705-000V | 5.13 | 0.20 |
| R-008397732-000W | 3.27 | 0.01 |
| R-008397735-000X | 2.92 | 0.03 |
| R-008397738-000Y | 3.97 | 0.06 |
| R-008397768-000A | 1.62 | 0.05 |
| R-008397771-000G | 4.45 | 0.17 |
| R-008397774-000H | −1.15 | 0.02 |
| R-008397777-000J | −1.16 | 0.09 |
| R-008397783-000S | −1.16 | 0.03 |
| R-008397807-000X | 2.52 | 0.05 |
| R-008397828-000R | 4.36 | 0.27 |
| R-008397855-000S | 1.94 | 0.01 |
| R-008397858-000T | 4.43 | 0.17 |
| R-008397882-000T | 5.26 | 0.10 |
| R-008397885-000U | 2.53 | 0.01 |
| R-008397888-000V | 3.55 | 0.03 |
| R-008397933-000Z | 4.19 | 0.22 |
| R-008397966-000C | 5.19 | 0.17 |
| R-008397969-000D | 3.35 | 0.11 |
| R-008397987-000W | 4.95 | 0.16 |
| R-008397990-000C | 4.69 | 0.09 |
| R-008397993-000D | 2.17 | 0.01 |
| R-008397996-000E | −1.14 | 0.02 |
| R-008398002-000V | 3.74 | 0.10 |
| R-008398020-000M | 3.51 | 0.06 |
| R-008398026-000P | 5.64 | 0.06 |
| R-008398050-000P | 3.57 | 0.10 |
| R-008398056-000S | 4.46 | 0.13 |
| R-008398086-000U | 3.65 | 0.18 |
| R-008398098-000D | 3.93 | 0.04 |
| R-008398119-000H | 2.68 | 0.25 |
| R-008398137-000A | 5.16 | 0.02 |
| R-008398140-000G | 3.87 | 0.14 |
| R-008398140-000G | 4.86 | 0.03 |
| R-008398143-000H | 1.74 | 0.05 |
| R-008398146-000J | 3.95 | 0.12 |
| R-008398149-000K | 4.45 | 0.03 |
| R-008398155-000T | 4.37 | 0.25 |
| R-008398161-000A | 3.82 | 0.05 |
| R-008398176-000L | 3.83 | 0.14 |
| R-008398182-000U | 4.52 | 0.06 |
| R-008398227-000T | 6.28 | 0.06 |
| R-008398239-000C | 2.48 | 0.02 |
| R-008398242-000J | 3.81 | 0.03 |
| R-008398245-000K | 5.34 | 0.23 |
| R-008398275-000M | 1.53 | 0.08 |
| R-008398278-000N | 2.71 | 0.07 |
| R-008398281-000V | 4.31 | 0.14 |
| R-008398326-000U | 5.66 | 0.09 |
| R-008398329-000V | 3.83 | 0.26 |
| R-008398332-000B | 4.63 | 0.02 |
| R-008398362-000D | 2.98 | 0.17 |
| R-008398365-000E | 5.06 | 0.06 |
| R-008398368-000F | 4.37 | 0.03 |
| R-008398374-000N | 3.66 | 0.03 |
| R-008398377-000P | −1.12 | 0.02 |
| R-008398401-000A | 4.57 | 0.18 |
| R-008398413-000K | 3.23 | 0.07 |
| R-008398419-000M | 3.78 | 0.10 |
| R-008398422-000U | 2.63 | 0.05 |
| R-008398425-000V | 3.31 | 0.02 |
| R-008398428-000W | 4.20 | 0.05 |
| R-008398431-000C | 4.82 | 0.02 |

TABLE 3c-continued

Primary screening data in MK2D Cells (n =2), recorded as log 2(fold change) in CTNNB1 gene expression.

| siNA Duplex ID | MK2D MEAN ΔΔCT | MK2D SD ΔΔCT |
|---|---|---|
| R-008398434-000D | 2.54 | 0.06 |
| R-008398437-000E | 5.38 | 0.09 |
| R-008398479-000S | 5.16 | 0.41 |
| R-008398482-000Y | 1.55 | 0.01 |
| R-008398533-000E | 3.60 | 0.01 |
| R-008398539-000G | 4.85 | 0.07 |
| R-008398542-000N | 3.64 | 0.01 |
| R-008398563-000G | 5.22 | 0.27 |
| R-008398566-000H | 2.69 | 0.13 |
| R-008398575-000S | 4.79 | 0.03 |
| R-008398584-000A | 2.92 | 0.04 |
| R-008398590-000H | 4.97 | 0.13 |
| R-008398593-000J | 4.52 | 0.03 |
| R-008398617-000P | 3.50 | 0.01 |
| R-008398647-000S | 4.34 | 0.23 |
| R-008398650-000Y | 4.26 | 0.01 |
| R-008398653-000Z | 3.27 | 0.22 |
| R-008398656-000A | 5.36 | 0.15 |
| R-008398662-000H | 5.03 | 0.42 |
| R-008398665-000J | 3.28 | 0.08 |
| R-008398668-000K | 5.53 | 0.41 |
| R-008398677-000U | 4.94 | 0.03 |
| R-008398686-000C | 1.43 | 0.14 |
| R-008398701-000E | 4.38 | 0.10 |
| R-008398740-000R | 3.54 | 0.04 |
| R-008398749-000U | 2.72 | 0.18 |
| R-008398782-000C | 2.87 | 0.02 |
| R-008398785-000D | −1.10 | 0.05 |
| R-008398788-000E | 5.61 | 0.09 |
| R-008398815-000S | 3.68 | 0.14 |
| R-008398821-000Z | 5.75 | 0.00 |
| R-008398830-000H | 4.45 | 0.21 |
| R-008398833-000J | 4.61 | 0.05 |
| R-008398836-000K | 3.83 | 0.01 |
| R-008398863-000L | −1.22 | 0.03 |
| R-008398866-000M | 3.99 | 0.02 |
| R-008398869-000N | 4.06 | 0.32 |
| R-008398872-000V | 4.32 | 0.18 |
| R-008398875-000W | 3.28 | 0.08 |
| R-008398902-000H | 5.58 | 0.03 |
| R-008398917-000U | 2.05 | 0.13 |
| R-008398923-000B | 5.33 | 0.13 |
| R-008398926-000C | 2.22 | 0.07 |
| R-008398956-000E | 3.78 | 0.15 |
| R-008398962-000M | 1.67 | 0.04 |
| R-008398965-000N | 4.87 | 0.13 |
| R-008398968-000P | 3.76 | 0.21 |
| R-008399031-000H | 4.84 | 0.16 |
| R-008399034-000J | 5.71 | 0.05 |
| R-008399037-000K | 2.86 | 0.08 |
| R-008399049-000V | 3.77 | 0.01 |
| R-008399058-000D | 3.88 | 0.26 |
| R-008399070-000U | 5.31 | 0.00 |
| R-008399091-000M | 4.67 | 0.01 |
| R-008399103-000H | 3.75 | 0.18 |
| R-008399109-000K | 5.39 | 0.14 |
| R-008399133-000K | 3.73 | 0.05 |
| R-008399145-000V | 4.27 | 0.01 |
| R-008399172-000W | 3.39 | 0.07 |
| R-008399175-000X | 3.44 | 0.11 |
| R-008399181-000E | 3.37 | 0.06 |
| R-008399184-000F | 6.50 | 0.11 |
| R-008399187-000G | 4.29 | 0.10 |
| R-008399202-000J | 4.09 | 0.44 |
| R-008399205-000K | 2.85 | 0.21 |
| R-008399208-000L | 4.45 | 0.00 |
| R-008399211-000T | 4.08 | 0.08 |
| R-008399214-000U | 4.54 | 0.01 |
| R-008399226-000D | 2.02 | 0.05 |
| R-008399262-000N | 4.13 | 0.06 |
| R-008399265-000P | 3.87 | 0.03 |
| R-008399268-000R | 5.89 | 0.30 |
| R-008399271-000X | 4.44 | 0.18 |
| R-008399274-000Y | 1.24 | 0.07 |
| R-008399334-000N | 2.96 | 0.22 |
| R-008399343-000X | 3.86 | 0.02 |
| R-008399370-000Y | 1.45 | 0.92 |
| R-008399373-000Z | 3.64 | 0.17 |
| R-008399376-000A | 4.79 | 0.22 |
| R-008399382-000H | 4.33 | 0.06 |
| R-008399394-000T | 4.40 | 0.09 |
| R-008399415-000X | 3.21 | 0.15 |
| R-008399418-000Y | 3.33 | 0.13 |
| R-008399421-000E | 3.57 | 0.21 |
| R-008399436-000R | −1.18 | 0.08 |
| R-008399439-000S | 3.23 | 0.13 |
| R-008399442-000Y | 4.12 | 0.04 |
| R-008399445-000Z | −0.90 | 0.12 |
| R-008399451-000G | 2.57 | 0.66 |
| R-008399454-000H | 1.55 | 0.01 |
| R-008399457-000J | 2.95 | 0.00 |
| R-008399481-000J | 2.30 | 0.08 |
| R-008399487-000L | 2.81 | 0.26 |
| R-008399526-000H | 5.38 | 0.35 |
| R-008399535-000S | 3.24 | 0.04 |
| R-008399538-000T | 4.18 | 0.28 |
| R-008399568-000V | 3.85 | 0.13 |
| R-008399571-000B | 4.51 | 0.28 |
| R-008399589-000N | 2.43 | 0.07 |
| R-008399592-000V | 5.11 | 0.02 |
| R-008399604-000R | −1.15 | 0.03 |
| R-008399610-000Y | 4.97 | 0.16 |
| R-008399616-000A | 2.18 | 0.03 |
| R-008399628-000K | 4.04 | 0.00 |
| R-008399634-000T | 3.53 | 0.23 |
| R-008399640-000A | 3.90 | 0.16 |
| R-008399652-000K | 4.94 | 0.03 |
| R-008399655-000L | 3.57 | 0.14 |
| R-008399658-000M | 3.74 | 0.42 |
| R-008399661-000U | 3.01 | 0.06 |
| R-008399664-000V | 3.84 | 0.16 |
| R-008399670-000C | 5.25 | 0.09 |
| R-008399679-000F | 3.51 | 0.29 |
| R-008399682-000M | 1.20 | 0.08 |

Select high ranking siNAs from Tables 3a & 3b were further analyzed for efficacy and potency in Huh7 cells use dose response curves. The results for these siNAs are shown in Table 4. The potency 50 is the calculated siNA transfection concentration that produces 50% target mRNA knockdown. The 1050 was determined after 24 hour exposure time.

TABLE 4

Dose response data for various siNAs in Huh 7 cells. Calculated maximum ΔΔCt is determined from the dose response curve.

| siNA Duplex ID | Mean ΔΔCt | SD ΔΔCt | POTENCY 50 (nM) | IC50 (nM) |
|---|---|---|---|---|
| R-008362824-000R | 4.18 | 0.09 | 0.02 | 0.02 |
| R-008362821-000P | 4.16 | 0.01 | 0.02 | 0.02 |
| R-008363031-000Y | 4.10 | 0.24 | 0.01 | 0.01 |
| R-008362785-000U | 4.00 | 0.31 | 0.03 | 0.03 |
| R-008362686-000T | 3.98 | 0.18 | 0.07 | 0.06 |
| R-008362782-000T | 3.95 | 0.55 | 0.05 | 0.04 |
| R-008362875-000L | 3.61 | 0.36 | 0.02 | 0.02 |
| R-008308997-000F | 3.59 | 0.14 | 0.02 | 0.02 |
| R-008362722-000N | 3.58 | 0.23 | 0.03 | 0.02 |
| R-008362791-000B | 3.51 | 0.89 | 0.02 | 0.01 |
| R-008362932-000A | 3.48 | 0.46 | 0.02 | 0.02 |

TABLE 4-continued

Dose response data for various siNAs in Huh 7 cells. Calculated maximum ΔΔCt is determined from the dose response curve.

| siNA Duplex ID | Mean ΔΔCt | SD ΔΔCt | POTENCY 50 (nM) | IC50 (nM) |
|---|---|---|---|---|
| R-008362689-000U | 3.39 | 0.81 | 0.02 | 0.02 |
| R-008363043-000H | 3.29 | 0.01 | 0.02 | 0.02 |
| R-008363073-000K | 3.21 | 0.45 | 0.10 | 0.08 |
| R-008362812-000F | 3.07 | 0.40 | 0.03 | 0.03 |
| R-008362947-000L | 3.07 | 0.28 | 0.02 | 0.01 |
| R-008363070-000J | 2.91 | 0.10 | 0.01 | 0.01 |

Additional siNAs from Tables 3a & 3b were further analyzed for efficacy and potency in MK2D cells using dose response curves. The results for these siNAs are shown in Table 5. The potency 50 is the calculated siNA transfection concentration that produces 50% target mRNA knockdown. The IC50 was determined after 24 hour exposure time.

TABLE 5

Dose response data for various siNAs in MK2D cells. Calculated maximum ΔΔCt is determined from the dose response curve.

| siNA Duplex ID | Mean ΔΔCt | SD ΔΔCt | IC50 (nM) |
|---|---|---|---|
| R-008380929-000H002 | 6.8 | 0.03 | 0.004 |
| R-008488882-000B001 | 5.8 | 0.01 | 0.004 |
| R-008488885-000C001 | 6.1 | 0.03 | 0.007 |
| R-008488887-000V001 | 6.6 | 0.02 | 0.004 |
| R-008488889-000M001 | 6.4 | 0.23 | 0.005 |

Example 2

Determining In Vitro Serum Stability of siNAs siNAs are reconstituted as 50 µM to 100 µM stock solution with $H_2O$ and added to human serum pre-warmed to 37° C. to a final concentration of 20 µg/mL. The mixture is then incubated at 37° C. for 0, 1 and 2 hours. At the end of each time point, the reactions are stopped by mixing with equal volume of Phenomenex Lysis-Loading Buffer. Oligonucleotides are purified in 96-well format by Phenomenex Solid Phase Extraction and lyophilized until dry with Labconco Triad Lyo-00417. The lyophilized samples are reconstituted in 150 µL of 1 mM EDTA prepared with RNase-free $H_2O$. The sample solutions are then diluted 5 fold with 1 mM EDTA for liquid chromatography/mass spectrometry (LC/MS) analysis on ThermoFisher Orbitrap. Serum metabolites of the siNAs were determined based on the measured molecular weights.

Example 3

Testing of Cytokine Induction

To assess immunostimulative effects of various siNAs of the invention loaded in lipid nanoparticles (DLinDMA/Cholesterol/S-PEG-C-DMA/DSPC in a 40/48/2/10 ratio), C57Bl/6 mice are dosed with a single 3 mpk dose of LNP formulated siNAs through tail vein injection. Serum or plasma samples are collected at 3 and 24 hours post-dose. The cytokine and chemokine levels in these samples is measured with the SearchLight IR Cytokine Array from Aushon Biosciences according to the manufacturer's instruction. The cytokines and chemokines measured are IL-1α, IL-1β, IL-6, KC, IL-10, IFNγ, TNF, GMCSF, MIP-1β, MCP-1/JE, and RANTES.

Example 4

Efficacy Studies in Mouse

Mice are dosed IV via tail vein injections with LNP encapsulated siNAs or vehicle control using 2 different 3-week dosing schemes: one 1 mg/kg dose for 3 consecutive days or a single 6 mg/kg does per week. In some experiments, the mice are co-dosed with sorafenib at a dose of 100 mg/kg BID every day for 3 weeks. Total tumor burden is measured by micro-CT scan imaging. The animals are sacrificed 5 days after the last siNA dose (Day 23), and normal liver and tumor tissues from each animal is collected for RNA purification. Total RNA is purified using RNeasy 96 kit (Qiagen, Cat#74182). cDNA is generated from total RNA using High Capacity cDNA Reverse Transcription Kit (Cat#: 4368813). Quantitative PCR reactions are performed with TaqMan Universal PCR Master Mix (Cat#: 4304437). Human CTNNB1 TaqMan Gene Expression Assay (Hs00355045_m1) and human GAPDH TaqMan Gene Expression Assay is used to monitor the mRNA level of both transcripts in tumor tissue. Mouse CTNNB1 TaqMan Gene Expression Assay (Mm00483033_m1) and mouse GAPDH TaqMan Gene Expression Assay is used to monitor the mRNA level of both transcripts in liver tissue. The expression level of CTNNB1 is normalized against GAPDH to minimize technical variations.

Example 5

Pharmacodynamic Study in Non-Human Primates

Rhesus macaque monkeys are dosed with a single 2.5 mpk dose of siNA loaded lipid nanoparticles through intravenous infusion. To monitor target mRNA knockdown, liver biopsies are performed at various time points pre- and post-dose with 16T gauge Menghini needles for about 20 mg tissue per animal. Whole blood and serum/plasma is also collected at different time points pre- and post-dose to monitor potential toxicity associated with the treatments. All procedures adhere to the regulations outlined in the USDA Animal Welfare Act (9 CFR, Parts 1, 2 and 3) and the conditions specified in The Guide for Care and Use of Laboratory Animals (ILAR publication, 1996, National Academy Press). Total RNA from the liver biopsy tissue was purified using RNeasy 96 kit (Qiagen, Cat#74182). cDNA was generated from total RNA using High Capacity cDNA Reverse Transcription Kit (Cat#: 4368813). Quantitative PCR reactions were performed with TaqMan Universal PCR Master Mix (Cat#: 4304437). Human CTNNB1 TaqMan Gene Expression Assay (Hs00355045_m1) and rhesus GAPDH TaqMan Gene Expression Assay (Rh02621745_g1) is used to monitor the mRNA level of both transcripts in liver biopsy tissue. The expression level of CTNNB1 is normalized against GAPDH to minimize technical variations.

LNP formulations (DLinDMA/Cholesterol/S-PEG-C-DMA/DSPC in a 40/48/2/10 ratio) comprising the siNA are tested. Log 2(fold change) in CTNNB1 gene expression is determined on days 3, 7, 14, and 28 days post-dosing. Pre-dose CTNNB1 expression levels for the monkey is measured 7 days before the first dosing.

Example 6

Pharmacodynamic Studies in Mouse

Mice were dosed IV via tail vein injections with LNP encapsulated siNAs or vehicle control using a single 0.33 mg/kg. Five animals which received each treatment were sacrificed 2, 7, 14 and 21 days after the siNA dose, and liver tissues from each animal was collected for RNA purification. Total RNA was purified using RNeasy 96 kit (Qiagen, Cat#74182). cDNA was generated from total RNA using High Capacity cDNA Reverse Transcription Kit (Cat#: 4368813). Quantitative PCR reactions were performed with TaqMan Universal PCR Master Mix (Cat#: 4304437). Mouse CTNNB1 TaqMan Gene Expression Assay (Mm00483033_m1) and mouse GAPDH TaqMan Gene Expression Assay was used to monitor the mRNA level of both transcripts. The expression level of CTNNB1 was normalized against GAPDH to minimize technical variations. Data is shown in Table 6.

time points pre- and post-dose with 16T gauge Menghini needles for about 20 mg tissue per animal. Whole blood and serum/plasma is also collected at different time points pre- and post-dose to monitor potential toxicity associated with the treatments. All procedures adhered to the regulations outlined in the USDA Animal Welfare Act (9 CFR, Parts 1, 2 and 3) and the conditions specified in The Guide for Care and Use of Laboratory Animals (ILAR publication, 1996, National Academy Press). Total RNA from the liver biopsy tissue was purified using RNeasy 96 kit (Qiagen, Cat#74182). cDNA was generated from total RNA using High Capacity cDNA Reverse Transcription Kit (Cat#: 4368813). Quantitative PCR reactions were performed with TaqMan Universal PCR Master Mix (Cat#: 4304437). Human CTNNB1 TaqMan Gene Expression Assay (Hs00355045_m1) and rhesus GAPDH TaqMan Gene Expression Assay (Rh02621745_m1) was used to monitor the mRNA level of both transcripts in liver biopsy tissue. The expression level of CTNNB1 was normalized against GAPDH to minimize tech-

TABLE 6

In vivo screening data in C57B1/6 mice, recorded as log 2(fold change) in CTNNB1 gene expression.

|  | Day 2 | | Day 7 | | Day 14 | | Day 21 | |
| --- | --- | --- | --- | --- | --- | --- | --- | --- |
|  | Mouse Mean ΔΔCT | Mouse SD ΔΔCT | Mouse Mean ΔΔCT | Mouse SD ΔΔCT | Mouse Mean ΔΔCT | Mouse SD ΔΔCT | Mouse Mean ΔΔCT | Mouse SD ΔΔCT |
| PBS | 0.00 | 0.23 | 0.00 | 0.21 | 0.00 | 0.16 | 0.00 | 0.15 |
| R-008380929-000H | 2.95 | 0.27 | 2.76 | 0.14 | 2.33 | 0.09 | 1.95 | 0.33 |
| R-008381104-000W | 2.90 | 0.21 | 2.43 | 0.26 | 1.77 | 0.30 | 1.32 | 0.23 |
| R-008488882-000B | 3.21 | 0.37 | 2.86 | 0.33 | 2.34 | 0.14 | 1.93 | 0.18 |
| R-008488885-000C | 2.44 | 0.13 | 1.35 | 0.22 | 0.59 | 0.17 | 0.58 | 0.31 |
| R-008488887-000V | 2.11 | 0.31 | 1.76 | 0.14 | 0.94 | 0.42 | 1.05 | 0.32 |
| R-008488889-000M | 2.31 | 0.22 | 1.87 | 0.35 | 1.30 | 0.10 | 0.86 | 0.17 |

Example 7

Pharmacodynamic Study in Non-Human Primates

Rhesus macaque monkeys were dosed with a single 3.34 mg/m² of body surface area dose of siNA loaded lipid nanoparticles through intravenous infusion. To monitor target mRNA knockdown, liver biopsies were performed at various nical variations. Data is shown in Table 7. LNP formulations (DLinDMA/Cholesterol/S-PEG-C-DMA/DSPC in a 40/48/2/10 ratio) comprising the siNA were tested. Log 2(fold change) in CTNNB1 gene expression was determined on days 2 and 7 days post-dosing. Pre-dose CTNNB1 expression levels for the monkey is measured 6 days before the first dosing.

TABLE 7

In vivo screening data in rhesus, recorded as log 2(fold change) in CTNNB1 gene expression.

|  |  | Day -6 | | Day 2 | | Day 7 | |
| --- | --- | --- | --- | --- | --- | --- | --- |
|  | siNA duplex | Rhesus Mean ΔΔCT | Rhesus SD ΔΔCT | Rhesus Mean ΔΔCT | Rhesus SD ΔΔCT | Rhesus Mean ΔΔCT | Rhesus SD ΔΔCT |
| LNP | PBS | 0.00 | 0.37 | 0.00 | 0.24 | 0.00 | 0.25 |
| LNP-2 | R-008488882-000B | −0.11 | 0.20 | 1.41 | 0.35 | 0.73 | 0.56 |
| LNP-4 | R-008488885-000C | −0.15 | 0.13 | 1.79 | 0.46 | 1.64 | 0.59 |
| LNP-1 | R-008488889-000M | 0.02 | 0.29 | 1.59 | 0.43 | 1.44 | 0.60 |
| LNP-3 | R-008380929-000H | −0.10 | 0.25 | 1.89 | 0.17 | 1.60 | 0.04 |

Example 8

Short Interfering Nucleic Acid Lipid Nanoparticle (LNP) Formulations

A. General LNP Process Description for LNP Formulations:

The lipid nanoparticles were prepared by an impinging jet process. The particles were formed by mixing lipids dissolved in alcohol with siNA dissolved in a citrate buffer. The lipid solution contained a cationic lipid, a helper lipid (cholesterol), PEG (e.g. PEG-C-DMA, PEG-DMG) lipid, and DSPC at a concentration of 5-15 mg/mL with a target of 9-12 mg/mL in an alcohol (for example ethanol). The ratio of the lipids had a mole percent range of 25-98 for the cationic lipid with a target of 35-65, the helper lipid had a mole percent range from 0-75 with a target of 30-50, the PEG lipid has a mole percent range from 1-15 with a target of 1-6, and the DSPC had a mole percent range of 0-15 with a target of 0-12. The siNA solution contained one or more siNA sequences at a concentration range from 0.3 to 0.6 mg/mL with a target of 0.3-0.9 mg/mL in a sodium citrate buffered salt solution with pH in the range of 3.5-5. The two solutions were heated to a temperature in the range of 15-40° C., targeting 30-40° C., and then mixed in an impinging jet mixer instantly forming the LNP. The teeID had a range from 0.25 to 1.0 mm and a total flow rate from 10-600 mL/minute. The combination of flow rate and tubing ID had the effect of controlling the particle size of the LNPs between 30 and 200 nm. The LNP suspension was then mixed with a buffered solution at a higher pH with a mixing ratio in the range of 1:1 to 1:3 vol:vol, but targeting 1:2 vol:vol. This buffered solution was at a temperature in the range of 15-40° C., targeting 30-40° C. This LNP suspension was further mixed with a buffered solution at a higher pH and with a mixing ratio in the range of 1:1 to 1:3 vol:vol, but targeting 1:2 vol:vol. The buffered solution was at a temperature in the range of 15-40° C., targeting 30-40° C. The mixed LNPs were held from 30 minutes to 2 hrs prior to an anion exchange filtration step. The temperature during incubating was in the range of 15-40° C., targeting 30-40° C. After incubating, the LNP suspension was filtered through a 0.8 um filter containing an anion exchange separation step. This process used tubing IDs ranging from 1 mm ID to 5 mm ID and a flow rate from 10 to 2000 mL/minute The LNPs were concentrated and diafiltered via an ultrafiltration process where the alcohol was removed and the citrate buffer was exchanged for the final buffer solution such as phosphate buffered saline. The ultrafiltration process used a tangential flow filtration format (TFF). This process used a membrane nominal molecular weight cutoff range from 30-500 KD. The membrane format was hollow fiber or flat sheet cassette. The TFF processes with the proper molecular weight cutoff retained the LNP in the retentate and the filtrate or permeate contained the alcohol; citrate buffer; and final buffer wastes. The TFF process is a multiple step process with an initial concentration to a siNA concentration of 1-3 mg/mL. Following concentration, the LNP suspension was diafiltered against the final buffer for 10-20 volumes to remove the alcohol and perform buffer exchange. The material was then concentrated an additional 1-3 fold. The final steps of the LNP process were to sterile filter the concentrated LNP solution and vial the product.

Analytical Procedure:

1) siNA Concentration

The siNA duplex concentrations were determined by Strong Anion-Exchange High-Performance Liquid Chromatography (SAX-HPLC) using Waters 2695 Alliance system (Water Corporation, Milford Mass.) with a 2996 PDA detector. The LNPs, otherwise referred to as RNAi Delivery Vehicles (RDVs), were treated with 0.5% Triton X-100 to free total siNA and analyzed by SAX separation using a Dionex BioLC DNAPac PA 200 (4×250 mm) column with UV detection at 254 nm. Mobile phase was composed of A: 25 mM $NaClO_4$, 10 mM Tris, 20% EtOH, pH 7.0 and B: 250 mM $NaClO_4$, 10 mM Tris, 20% EtOH, pH 7.0 with a liner gradient from 0-15 min and a flow rate of 1 ml/minute. The siNA amount was determined by comparing to the siNA standard curve.

2) Encapsulation Rate

Fluorescence reagent SYBR Gold was employed for RNA quantitation to monitor the encapsulation rate of RDVs. RDVs with or without Triton X-100 were used to determine the free siNA and total siNA amount. The assay is performed using a SpectraMax M5e microplate spectrophotometer from Molecular Devices (Sunnyvale, Calif.). Samples were excited at 485 nm and fluorescence emission was measured at 530 nm. The siNA amount is determined by comparing to an siNA standard curve.

Encapsulation rate=(1−free siNA/total siNA)×100%

3) Particle Size and Polydispersity

RDVs containing 1 μg siNA were diluted to a final volume of 3 ml with 1×PBS. The particle size and polydispersity of the samples was measured by a dynamic light scattering method using ZetaPALS instrument (Brookhaven Instruments Corporation, Holtsville, N.Y.). The scattered intensity was measured with He—Ne laser at 25° C. with a scattering angle of 90°.

4) Zeta Potential Analysis

RDVs containing 1 μg siNA were diluted to a final volume of 2 ml with 1 mM Tris buffer (pH 7.4). Electrophoretic mobility of samples was determined using ZetaPALS instrument (Brookhaven Instruments Corporation, Holtsville, N.Y.) with electrode and He—Ne laser as a light source. The Smoluchowski limit was assumed in the calculation of zeta potentials.

5) Lipid Analysis

Individual lipid concentrations were determined by Reverse Phase High-Performance Liquid Chromatography (RP-HPLC) using Waters 2695 Alliance system (Water Corporation, Milford Mass.) with a Corona charged aerosol detector (CAD) (ESA Biosciences, Inc, Chelmsford, Mass.). Individual lipids in RDVs were analyzed using an Agilent Zorbax SB-C18 (50×4.6 mm, 1.8 μm particle size) column with CAD at 60° C. The mobile phase was composed of A: 0.1% TFA in $H_2O$ and B: 0.1% TFA in IPA. The gradient changed from 60% mobile phase A and 40% mobile phase B from time 0 to 40% mobile phase A and 60% mobile phase B at 1.00 min; 40% mobile phase A and 60% mobile phase B from 1.00 to 5.00 min; 40% mobile phase A and 60% mobile phase B from 5.00 min to 25% mobile phase A and 75% mobile phase B at 10.00 min; 25% mobile phase A and 75% mobile phase B from 10.00 min to 5% mobile phase A and 95% mobile phase B at 15.00 min; and 5% mobile phase A and 95% mobile phase B from 15.00 to 60% mobile phase A and 40% mobile phase B at 20.00 min with a flow rate of 1 ml/minute. The individual lipid concentration was determined by comparing to the standard curve with all the lipid components in the RDVs with a quadratic curve fit. The molar percentage of each lipid was calculated based on its molecular weight.

B. General LNP Preparation for Various Formulations in Table 11 siNA nanoparticle suspensions in Table 11 were prepared by dissolving siNAs and/or carrier molecules in 20 mM sodium citrate buffer (pH 5.0) at a concentration of about 0.40 mg/mL. Lipid solutions were prepared by dissolving a mixture of cationic lipid (e.g., (13Z,16Z)—N,N-dimethyl-3-nonyldocosa-13,16-dien-1-amine, see structure in Table 12), DSPC, Cholesterol, and PEG-DMG (ratios shown in Table 11) in absolute ethanol at a concentration of about 8 mg/mL. The nitrogen to phosphate ratio was approximated to 6:1.

Nearly equal volumes of siNA/carrier and lipid solutions were delivered with two FPLC pumps at the same flow rates to a mixing T connector. A back pressure valve was used to adjust to the desired particle size. The resulting milky mixture was collected in a sterile glass bottle. This mixture was then diluted with an equal volume of citrate buffer, followed by equal volume of PBS (pH 7.4), and filtered through an ion-exchange membrane to remove any free siNA/carrier in the mixture. Ultra filtration against PBS (7.4)) was employed to remove ethanol and to exchange buffer. The final LNP was obtained by concentrating to the desired volume and sterile filtered through a 0.2 µm filter. The obtained LNPs were characterized in term of particle size, Zeta potential, alcohol content, total lipid content, nucleic acid encapsulated, and total nucleic acid concentration.

LNP Manufacture Process

In a non-limiting example, LNPs were prepared in bulk as follows. The process consisted of (1) preparing a lipid solution; (2) preparing an siNA/carrier solution; (3) mixing/particle formation; (4) incubation; (5) dilution; (6) ultrafiltration and concentration.

1. Preparation of Lipid Solution

2 L glass reagent bottles and measuring cylinders were depyrogenated. The lipids were warmed to room temperature. Into the glass reagent bottle was transferred 8.0 g of (13Z, 16Z)—N,N-dimethyl-3-nonyldocosa-13,16-dien-1-amine with a pipette and 1.2 g of DSPC, 3.5 g of Cholesterol, 0.9 g of PEG-DMG were added. To the mixture is added 1 L of ethanol. The reagent bottle was placed in heated water bath, at a temperature not exceeding 50° C. The lipid suspension was stirred with a stir bar. A thermocouple probe was put into the suspension through one neck of the round bottom flask with a sealed adapter. The suspension was heated at 30-40° C. until it became clear. The solution was allowed to cool to room temperature.

2. Preparation of siNA/Carrier Solution

Into a sterile container (Corning storage bottle) was weighed 0.4 g times the water correction factor (approximately 1.2) of siNA powder. The siNA was transferred to a depyrogenated 2 L glass reagent bottle. The weighing container was rinsed 3× with citrate buffer (20 mM, pH 5.0) and the rinses were placed into the 2 L glass bottle, QS with citrate buffer to 1 L. The concentration of the siNA solution was determined with a UV spectrometer using the following procedure. 20 µL was removed from the solution, diluted 50 times to 1000 µL, and the UV reading recorded at A260 nm after blanking with citrate buffer. This was repeated. Note, if the readings for the two samples are consistent, an average can be taken and the concentration calculated based on the extinction coefficients of the siNAs. If the final concentration is out of the range of 0.40±0.01 mg/mL, the concentration can be adjusted by adding more siNA/carrier powder, or adding more citrate buffer. This process can be repeated for the second siNA, if applicable When the siNA/carrier solution comprised a single siNA duplex instead of a cocktail of two or more siNA duplexes and/or carriers, then the siNA/carrier was dissolved in 20 mM citrate buffer (pH 5.0) to give a final concentration of 0.4 mg/mL.

The lipid and ethanol solutions were then sterile filtered through a Pall Acropak 20 0.8/0.2 µm sterile filter PN 12203 into a depyrogenated glass vessel using a Master Flex Peristaltic Pump Model 7520-40 to provide a sterile starting material for the encapsulation process. The filtration process was run at an 80 mL scale with a membrane area of 20 cm². The flow rate was 280 mL/minute. This process can be scaled by increasing the tubing diameter and the filtration area.

3. Particle Formation—Mixing Step

Using a two-barrel syringe driven pump (Harvard 33 Twin Syringe), the sterile lipid/ethanol solution and the sterile siNA/carrier or siNA/carrier cocktail/citrate buffer (20 mM citrate buffer, pH 5.0) solutions were mixed in a 0.5 mm ID T-mixer (Mixing Stage I) at equal, or nearly equal, flow rates. The resulting outlet LNP suspension contained 40-50 vol % ethanol. To obtain a 45 vol % ethanol outlet suspension, the sterile lipid/ethanol and the sterile siNA/carrier or siNA/carrier cocktail/citrate buffer solutions were mixed at flow rates of 54 mL/min and 66 mL/min, respectively, such that the total flow rate of the mixing outlet is 120 mL/min.

4. Dilution

The outlet stream of Mixing Stage I was fed directly into a 4 mm ID T-mixer (Mixing Stage II), where it was diluted with a buffered solution at higher pH (20 mM sodium citrate, 300 mM sodium chloride, pH 6.0) at a ratio of 1:1 vol:vol %. This buffered solution was at a temperature in the range of 30-40° C., and was delivered to the 4 mm T-mixer via a peristaltic pump (Cole Parmer MasterFlex L/S 600 RPM) at a flow rate of 120 mL/min.

The outlet stream of Mixing Stage II was fed directly into a 6 mm ID T-mixer (Mixing Stage III), where it was diluted with a buffered solution at higher pH (PBS, pH 7.4) at a ratio of 1:1 vol:vol %. This buffered solution was at a temperature in the range of 15-25° C., and was delivered to the 6 mm T-mixer via peristaltic pump (Cole Parmer MasterFlex L/S 600 RPM) at a flow rate of 240 mL/min.

5. Incubation and Free siNA Removal

The outlet stream of Mixing Stage III was held after mixing for 30 minute incubation. The incubation was conducted at temperature of 35-40° C. and the in-process suspension was protected from light. Following incubation, free (un-encapsulated) siNA was removed via anion exchange with Mustang Q chromatography filters (capsules). Prior to use, the chromatography filters were pre-treated sequentially with flushes of 1N NaOH, 1M NaCl, and a final solution of 12.5 vol % ethanol in PBS. The pH of the final flush was checked to ensure pH <8. The incubated LNP stream was then filtered via Mustang Q filters via peristaltic pump (Cole Parmer Master-Flex L/S 600 RPM) at flow rate of approximately 100 mL/min. The filtered stream was received into a sterile glass container for ultrafiltration and concentration as follows.

6. Ultrafiltration, Concentration and Sterile Filtration

The ultrafiltration process is a timed process and the flow rates must be monitored carefully. This is a two step process; the first is a concentration step taking the diluted material and concentrating approximately 8-fold, to a concentration of approximately 0.3-0.6 mg/mL siNA.

In the first step, a ring-stand with a ultrafiltration membrane 100 kDa PES (Spectrum Labs) installed was attached to a peristaltic pump (Spectrum KrosFloII System). 9.2 L of sterile distilled water was added to the reservoir; 3 L was drained to waste and the remainder was drained through permeate to waste. 5.3 L of 0.25 N sodium hydroxide was added to the reservoir with 1.5 L drained to waste and 3.1 L drained through permeate to waste. The remaining sodium hydroxide was held in the system for sanitization (at least 10 minutes), and then the pump was drained. 9.2 L of 70 (v/v) % isopropyl alcohol was added to the reservoir with 1.5 L drained to waste and the remainder drained through permeate to waste. 6 L of conditioning buffer (12.5% ethanol in phosphate buffered saline) was added with 1.5 L drained to waste and the remainder drained though the permeate until the waste was of neutral pH (7-8). A membrane flux value was recorded, and the pump was then drained.

The diluted LNP solution was placed into the reservoir to the 1.1 L mark. The pump was turned on at 2.3 L/min. After 5 minutes of recirculation, the permeate pump was turned on at 62.5 mL/min and the liquid level was constant at approximately 950 mL in the reservoir. The diluted LNP solution was concentrated from 9.8 L to 1.1 L in 140 minutes, and the pump was paused when all the diluted LNP solution has been transferred to the reservoir.

The second step was a diafiltration step exchanging the ethanol/aqueous buffer to phosphate buffered saline. During this step, approximately 10-20 diafiltration volumes of phosphate buffered saline were used. Following diafiltration, a second concentration was undertaken to concentrate the LNP suspension 3-fold to approximately 1-1.5 mg/mL siRNA. The concentrated suspension was collected into sterile, plastic PETG bottles. The final suspension was then filtered sequentially via Pall 0.45 um PES and Pall 0.2 um PES filters for terminal sterilization prior to vial filling.

The obtained LNPs were characterized in terms of particle size, Zeta potential, alcohol content, total lipid content, nucleic acid encapsulated, and total nucleic acid concentration.

C. Synthesis of Novel Cationic Lipids

Synthesis of the novel cationic lipids is a linear process starting from lipid acid (i). Coupling to N,O-dimethyl hydroxylamine gives the Weinreb amide ii. Grignard addition generates ketone iii. Titanium mediated reductive amination gives final products of type iv.

General Scheme 1

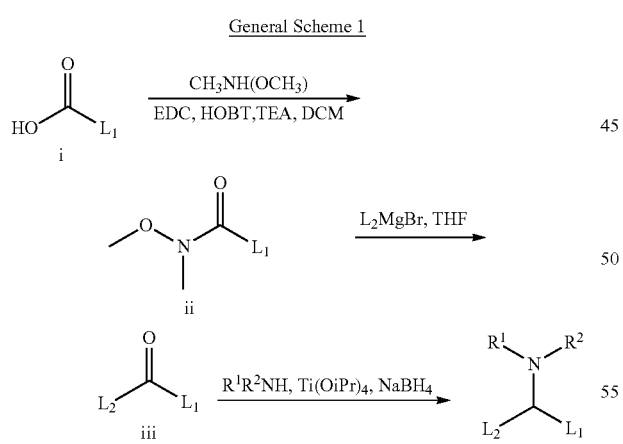

Synthesis of the single carbon homologated cationic lipids v is a linear process starting from lipid ketone (iii). Conversion of the ketone to the nitrile (iv) is accomplished via treatment with TOSMIC and potassium tert-butoxide. Reduction of the nitrile to the primary amine followed by reductive amination provides final cationic lipids v.

General Scheme 2

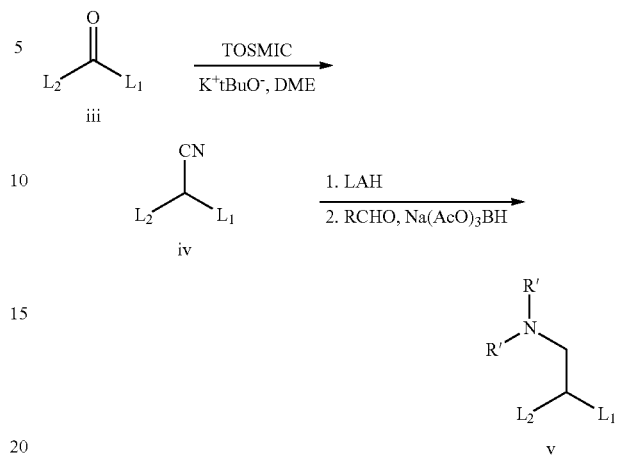

Synthesis of two carbon homologated cationic lipids viii is a linear process starting from lipid ketone (iii). Conversion of the ketone to the α,β-unsaturated amide vi is accomplished under Peterson conditions. Conjugate reduction of the α,β-unsaturation is performed using LS-Selectride to give amide vii. Reduction of the amide with lithium aluminum hydride provides final cationic lipids viii.

General Scheme 3

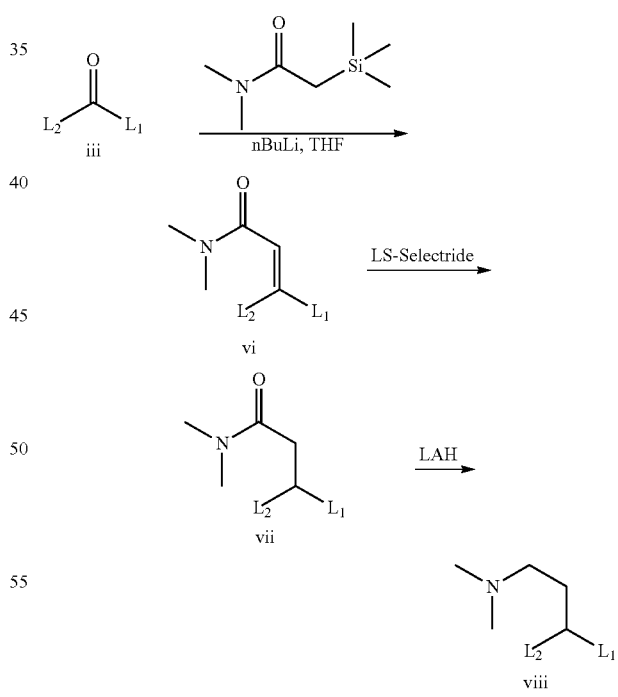

Cyclopropyl containing lipids are prepared according to General Scheme 4. Unsaturated Weinreb amides ii are subjected to Simmons-Smith cyclopropanation conditions to give cyclopropyl containing Weinreb amides ix. These are carried on to final products as outlined in General Schemes 1-3.

General Scheme 4

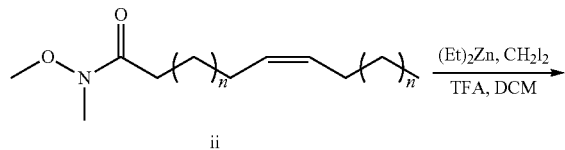

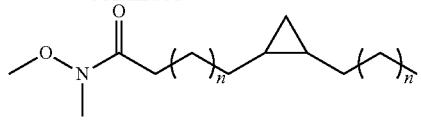

Synthesis of allylic amine cationic lipids xv is a linear process starting with aldehyde x. Addition of t-butyl acetate generates β-hydroxy ester xi. Conversion of the hydroxyl functionality to a fluoro group followed by acid treatment generates β-fluoro acid xii. Conversion of the acid to the Weinreb amide followed by Grignard addition gives the β-fluoro ketone xiv. Reductive amination results in simultaneous elimination to generate the desired allylic amine xv.

GENERAL SCHEME 5

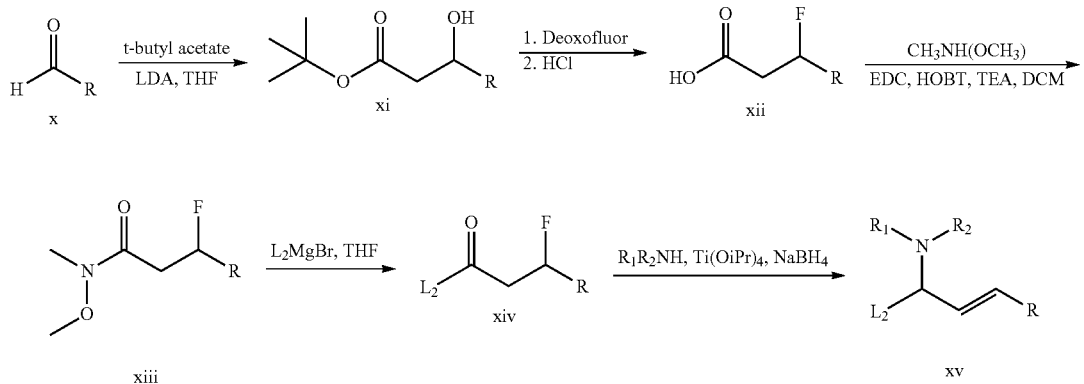

20,23-nonacosadien-10-amine, N,N-dimethyl-, (20Z,23Z) (Compound 1)

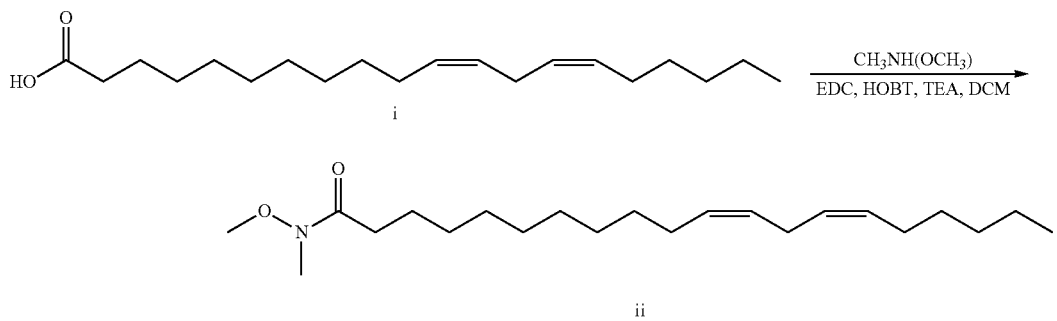

11,14-Eicosadienoic acid, (11Z,14Z)—(50 g, 162 mmol), N,O-Dimethylhydroxylamine hydrochloride (31.6 g, 324 mmol), HOAt (44.1 g, 324 mmol), Et$_3$N (45.2 mL, 324 mmol), and EDC (62.1 g, 324 mmol) were mixed in DCM (810 mL) and stirred overnight at ambient temperature. Reaction was then washed 5×700 mL water, then washed 1×600 mL 1 M NaOH, dried with sodium sulfate, filtered through celite and evaporated to obtain 53.06 g (93%) 11,14-eicosadienamide, N-methoxy-N-methyl-, (11Z,14Z) as a clear golden oil. $^1$H NMR (400 MHz, CDCl$_3$) δ 5.35 (m, 4H), 3.68 (s, 3H), 3.18 (s, 3H), 2.77 (m, 2H), 2.41 (t, J=7 Hz, 2H), 2.05 (m, 4H), 1.63 (m, 2H), 1.40-1.26 (m, 18H), 0.89 (t, J=7 Hz, 3H).

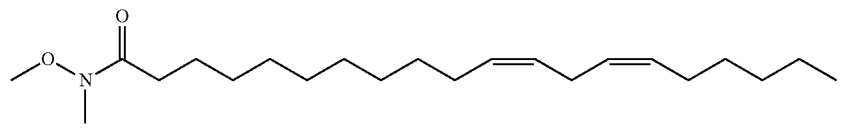
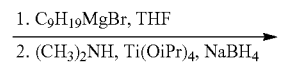

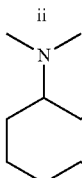

11,14-eicosadienamide, N-methoxy-N-methyl-, (11Z,14Z)-1 (4 g, 11.38 mmol) was dissolved in dry THF (50.0 ml) in a 250 mL flask then 1 M nonylmagnesium bromide (22.76 ml, 22.76 mmol) was added under nitrogen at ambient temperature. After 10 min, the reaction was slowly quenched with excess sat. aq $NH_4Cl$. The reaction was washed into a separatory funnel with hexane and water, shaken, the lower aqueous layer discarded, the upper layer dried with sodium sulfate, filtered, and evaporated to give crude ketone as a golden oil. To the above crude ketone was added dimethylamine (2 M in THF) (14.22 ml, 28.4 mmol) followed by $Ti(O-i-Pr)_4$ (6.67 ml, 22.76 mmol) and let stir overnight. The next day, added EtOH (50 ml) followed by $NaBH_4$ (0.646 g, 17.07 mmol). After 5 min of stirring, directly injected entire reaction onto a 40 g silica column that was in line with a 330 g silica column. Eluted 10 min 100% DCM, then 30 min 0-15% MeOH/DCM, collected 20,23-nonacosadien-10-amine, N,N-dimethyl-, (20Z,23Z) (1) (2.45 g, 5.47 mmol, 48.1% yield) as a faintly golden oil. $^1$H NMR (400 MHz, $CDCl_3$) δ 5.35 (m, 4H), 2.78 (m, 2H), 2.23 (m, 1H), 2.21 (s, 6H), 2.05 (m, 4H), 1.45-1.16 (m, 38H), 0.89 (m, 6H). HRMS calcd for $C_{31}H_{61}N$ 448.4877. found 448.4872.

Compounds 2-30 are novel cationic lipids and were prepared according to the General Scheme 1 above.

| Compound | Structure | HRMS |
|---|---|---|
| 2 | 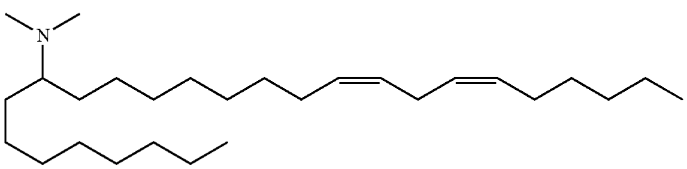 | calcd C28H56N 406.4407, found 406.4405. |
| 3 | 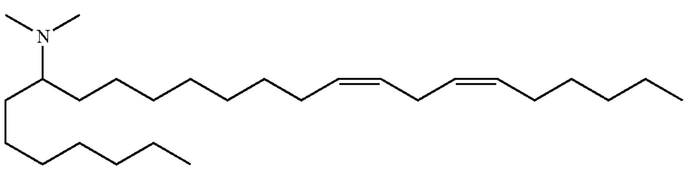 [SMILES: CCCCC/C=C\C/C=C\CCCCCCCC(CCCCCCC)N(C)C] | calcd C27H54N 392.4251, found 392.4250. |
| 4 | 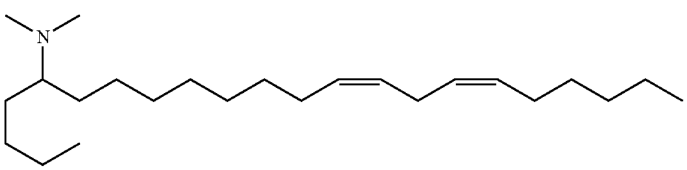 [SMILES: CCCCC/C=C\C/C=C\CCCCCCCC(CCCC)N(C)C] | calcd C24H48N 350.3781, found 350.3770. |
| 5 | 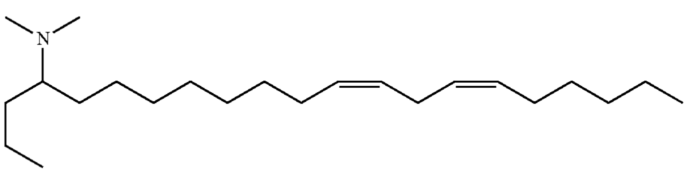 [SMILES: CCCCC/C=C\C/C=C\CCCCCCCC(CCC)N(C)C] | calcd C23H46N 336.3625, found 336.3613. |
| 6 | 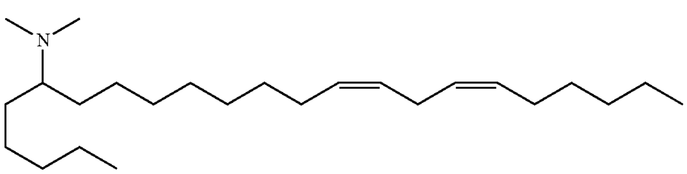 [SMILES: CCCCC/C=C\C/C=C\CCCCCCCC(CCCCC)N(C)C] | calcd C25H50N 364.3938, found 364.3941. |

-continued

| Compound | Structure | HRMS |
|---|---|---|
| 7 | 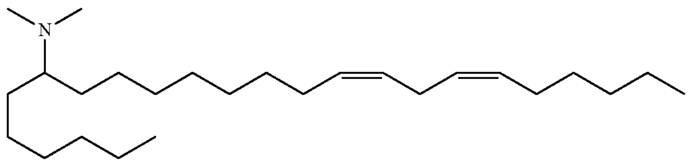 [SMILES: CCCCC/C=C\C/C=C\CCCCCCCC(CCCCCC)N(C)C] | calcd C26H52N 378.4094, found 378.4081. |
| 8 | 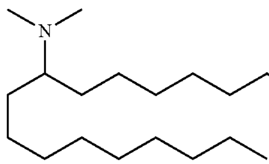 | calcd C29H58N 420.4564, found 420.4562. |
| 9 | 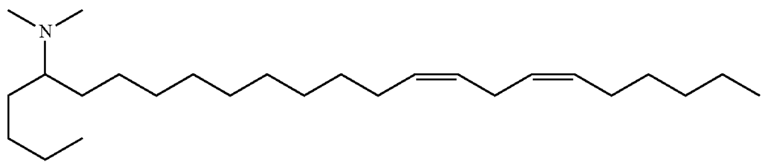 [SMILES: CCCCC/C=C\C/C=C\CCCCCCCCCC(CCCC)N(C)C] | calcd C26H52N 378.4094, found 378.4089. |
| 10 | 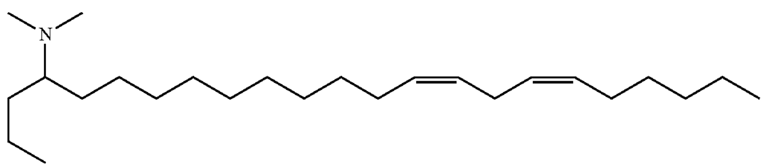 [SMILES: CCCCC/C=C\C/C=C\CCCCCCCCCC(CCC)N(C)C] | calcd C25H50N 364.3938, found 364.3931. |
| 11 | 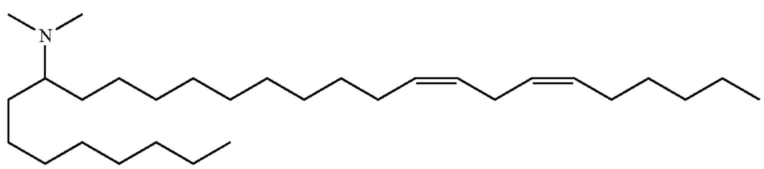 [SMILES: CCCCC/C=C\C/C=C\CCCCCCCCCC(CCCCCCCC)N(C)C] | calcd C30H60N 434.4720, found 434.4717. |
| 12 | 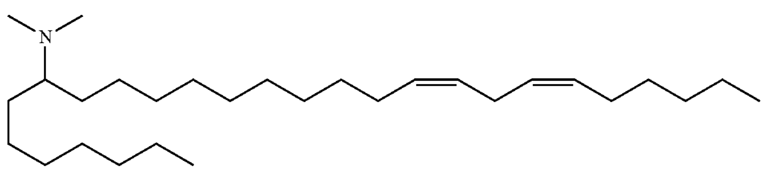 | calcd C29H58N 420.4564, found 420.4561. |
| 13 | 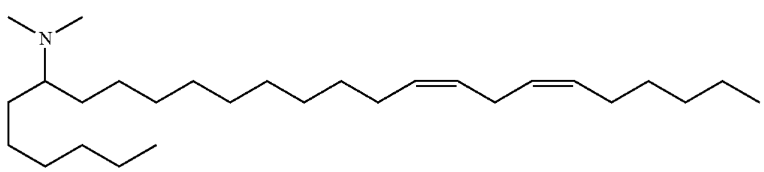 [SMILES: CCCCC/C=C\C/C=C\CCCCCCCCCC(CCCCCC)N(C)C] | calcd C28H56N 406.4407, found 406.4404. |
| 14 | 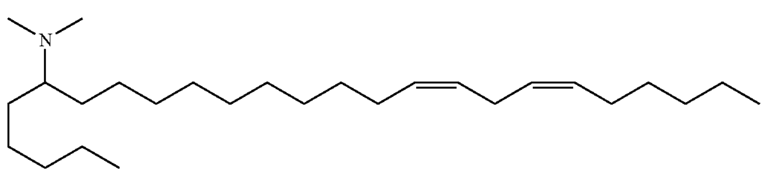 [SMILES: CCCCC/C=C\C/C=C\CCCCCCCCCC(CCCCC)N(C)C] | calcd C27H54N 392.4251, found 392.4245. |
| 15 | 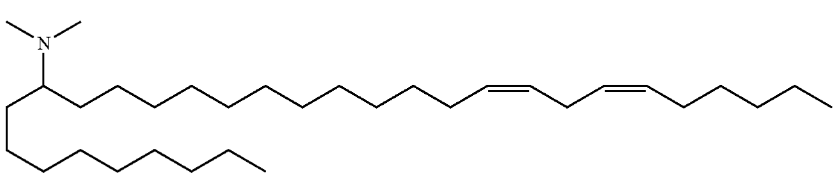 [SMILES: CCCCC/C=C\C/C=C\CCCCCCCCCCCC(CCCCCCCCC)N(C)C] | calcd C33H66N 476.5190, found 476.5196. |

-continued

| Compound | Structure | HRMS |
|---|---|---|
| 16 | 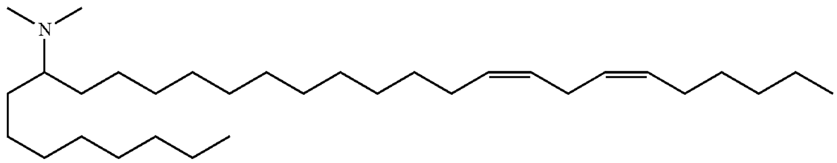 [SMILES: CCCCC/C=C\C/C=C\CCCCCCCCCCCC(CCCCCCCC)N(C)C] | calcd C32H64N 462.5033, found 462.5045. |
| 17 | 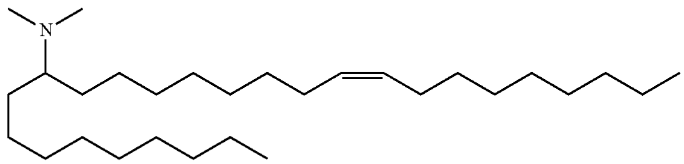 [SMILES: CCCCCCCC/C=C\CCCCCCCC(CCCCCCCCC)N(C)C] | calcd C29H59N 422.4720, found 422.4726. |
| 18 | 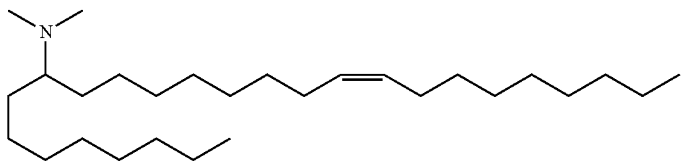 [SMILES: CCCCCCCC/C=C\CCCCCCCC(CCCCCCCC)N(C)C] | calcd C28H57N 408.4564, found 408.4570. |
| 19 | 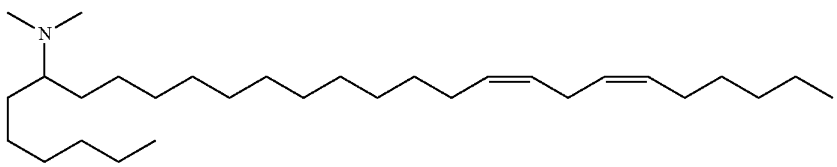 [SMILES: CCCCC/C=C\C/C=C\CCCCCCCCCCCC(CCCCCC)N(C)C] | calcd C30H59N 434.4720, found 434.4729. |
| 20 | 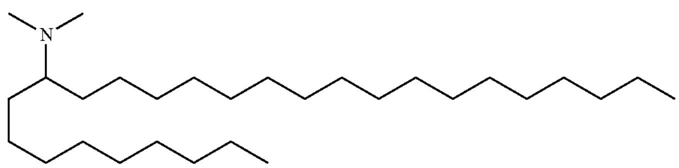 [SMILES: CCCCCCCCCCCCCCCCCC(CCCCCCCCC)N(C)C] | calcd C29H61N 424.4877, found 424.4875. |
| 21 | 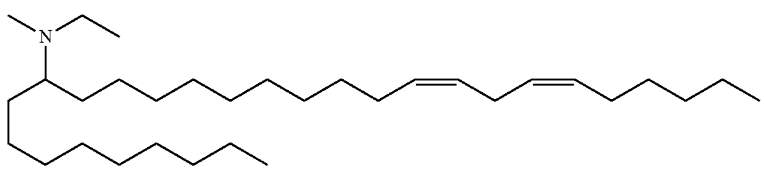 [SMILES: CCCCC/C=C\C/C=C\CCCCCCCCCC(CCCCCCCCC)N(C)CC] | calcd C32H64N 462.5033, found 462.5023. |
| 22 | 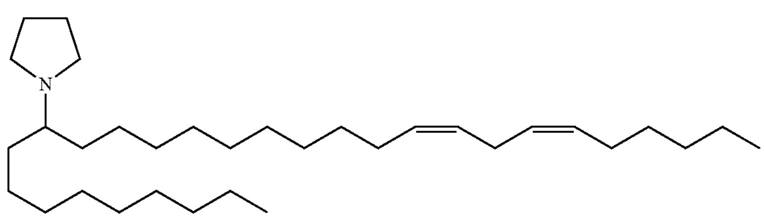 [SMILES: CCCCC/C=C\C/C=C\CCCCCCCCCC(CCCCCCCCC)N1CCCC1] | calcd C33H64N 474.5033, found 474.5033. |
| 23 | 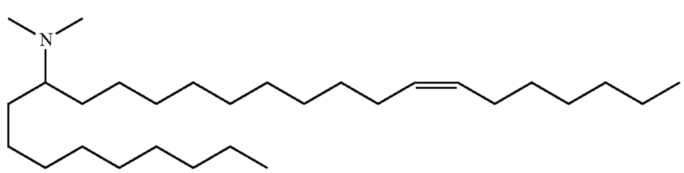 [SMILES: CCCCCC/C=C\CCCCCCCCCC(CCCCCCCCC)N(C)C] | calcd C29H60N 422.4720, found 422.4716. |
| 24 | 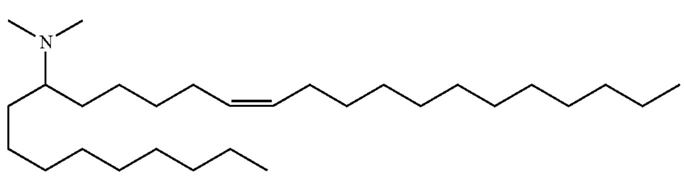 [SMILES: CCCCCCCCCCC/C=C\CCCCC(CCCCCCCCC)N(C)C] | calcd C29H60N 422.4720, found 422.4718. |

-continued
| Compound | Structure | HRMS |
|---|---|---|
| 25 | 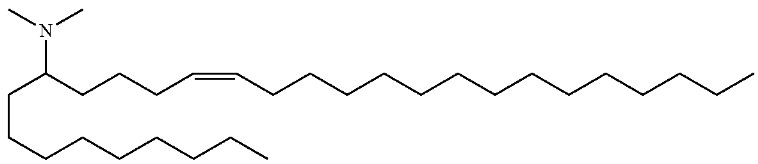 [SMILES: CCCCCCCCCCCCCC/C=C\CCCC(CCCCCCCCC)N(C)C] | calcd C31H64N 450.5033, found 450.5031. |
| 26 | 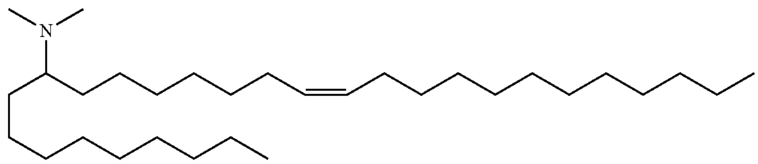 [SMILES: CCCCCCCCCCC/C=C\CCCCCCC(CCCCCCCCC)N(C)C] | calcd C31H64N 450.5033, found 450.5034. |
| 27 | 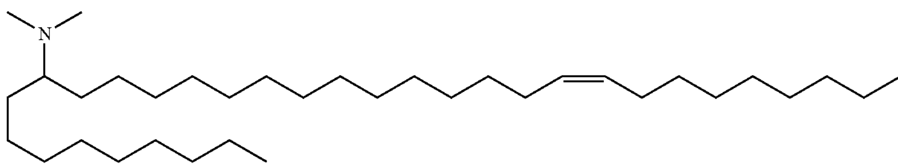 [SMILES: CCCCCCCC/C=C\CCCCCCCCCCCCCC(CCCCCCCCC)N(C)C] | calcd C35H72N 506.5659, found 506.5635. |
| 28 | 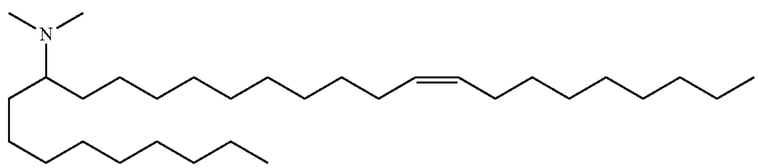 [SMILES: CCCCCCCC/C=C\CCCCCCCCCC(CCCCCCCCC)N(C)C] | calcd C31H64N 450.5033, found 450.5037. |
| 29 | 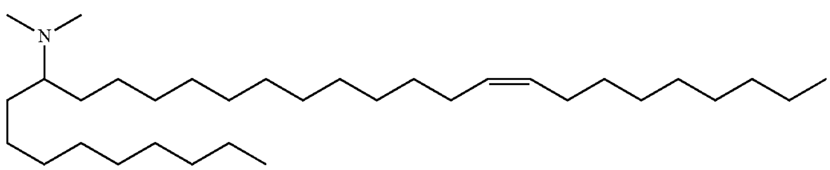 [SMILES: CCCCCCCC/C=C\CCCCCCCCCCCC(CCCCCCCCC)N(C)C] | calcd C33H68N 478.5346, found 478.5358. |
| 30 | 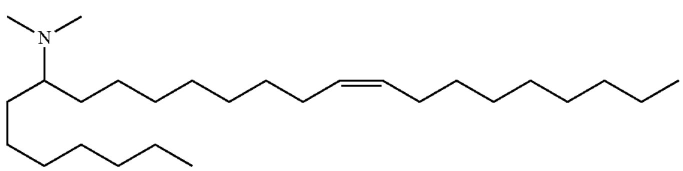 [SMILES: CCCCCCCC/C=C\CCCCCCCC(CCCCCCC)N(C)C] | calcd C27H56N 394.4407, found 394.4407. |
(12Z,15Z)—N,N-dimethyl-2-nonylhenicosa-12,15-dien-1-amine (Compound 31)
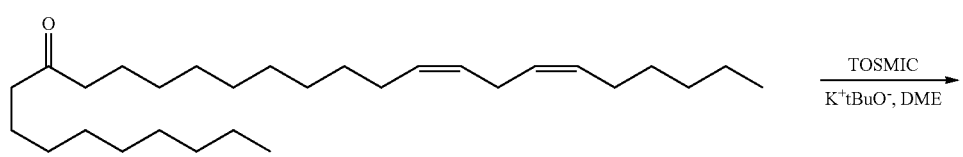
iii -continued

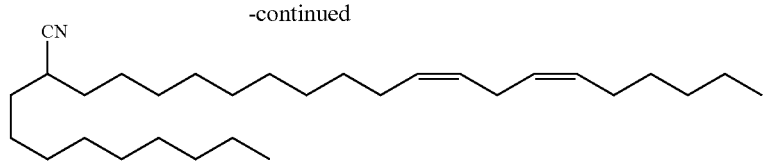

iv

A solution of keton iii (4.0 g, 9.55 mmol), TOSMIC (2.4 g, 12.4 mmol) in dimethoxyethane (45 mL) was cooled to 0° C. and treated with potassium tert-butoxide (19.1 mmol, 19.1 mL of a 1M solution in tBuOH). After 90 minutes, the reaction was partitioned between hexanes and water. The organics were washed with water, dried over sodium sulfate, filtered and evaporated in vacuo. This material was purified by flash chromatography (0-5% EtOAc/hexanes) to give desired product (containing ~20% of s.m.). This mixture was carried into next step as is. LC/MS (M+H)=430.6.

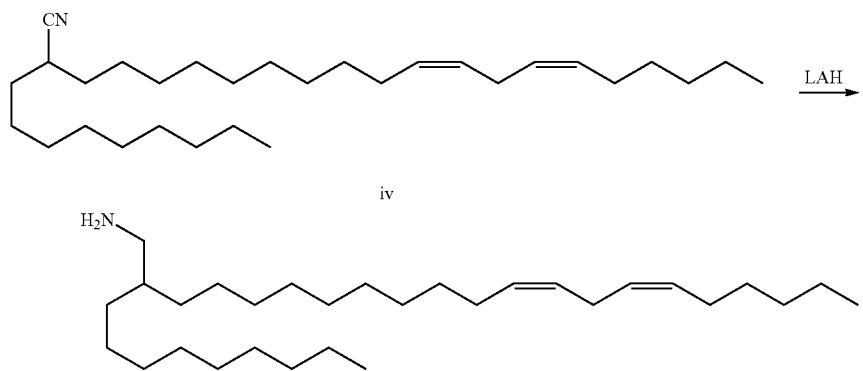

iv

Lithium aluminum hydride (23.9 mmol, 23.9 mL of a 1M solution in THF) was added directly to nitrile iv (3.42 g, 8 mmol) at ambient temperature and the reaction was stirred for 20 minutes. The reaction was diluted with 100 mL THF, cooled to 0° C. and carefully quenched with sodium sulfate decahydrate solution. The solids were filtered off and washed with THF. The filtrate was evaporated in vacuo and carried directly into next reaction crude. LC/MS (M+H)=434.6.

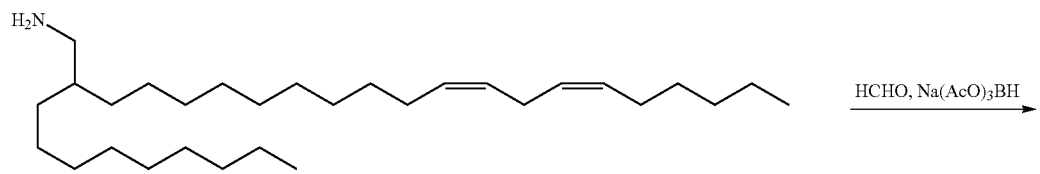

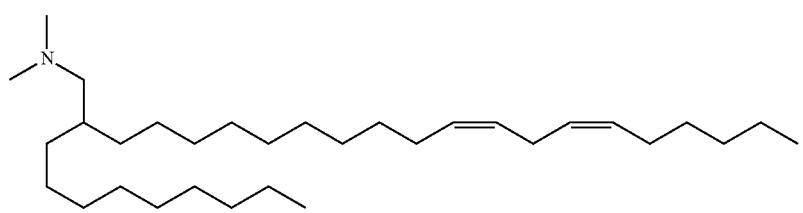

A solution of primary amine (3.45 g, 6.2 mmol) in dichloroethane (100 mL) was treated with formaldehyde (1.6 mL, 21.7 mmol) followed by sodium triacetoxyborohydride (6.6 g, 31 mmol). After 5 minutes, the reaction was partitioned between dichloromethane and 1N NaOH. The organics were dried over sodium sulfate, filtered and evaporated in vacuo. The crude mixture was purified by reverse phase preparative chromatography (C8 column) to provide (12Z,15Z)—N,N-dimethyl-2-nonylhenicosa-12,15-dien-1-amine. HRMS calc'd 462.5033. found 462.5026. ¹H NMR (400 MHz, CDCl₃) δ 5.35 (m, 4H), 2.78 (2H, t, J=5.6 Hz), 2.18 (s, 6H), 2.05 (m, 6H), 1.3 (m, 39H), 0.89 (m, 6H).

(13Z,16Z)—N,N-dimethyl-3-nonyldocosa-13,16-dien-1-amine (Compound 32)

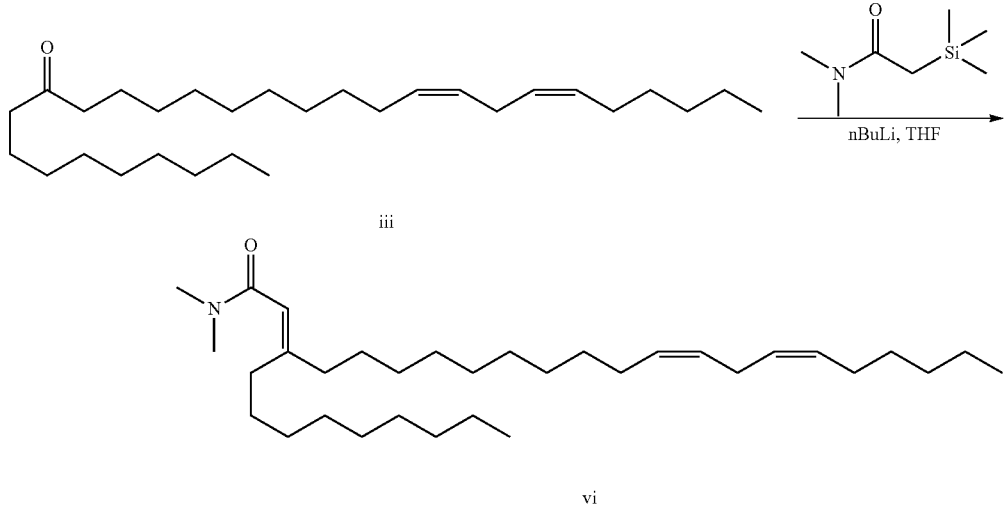

The silyl amide Peterson reagent (3.1 g, 16.7 mmol) was dissolved in THF (35 mL) and cooled to −63° C. To this solution was added nBuLi (16.7 mmol, 6.7 mL of a 2.5M solution). The reaction was warmed to ambient temperature for 30 minutes. The ketone (5.0 g, 11.9 mmol) was dissolved in THF (25 mL) in a second flask. The Peterson reagent was transferred to the ketone solution at −60° C. The reaction was warmed to −40° C. for 1 hour, then warmed to 0° C. for 30 minutes. The reaction was quenched with sodium bicarbonate, diluted with additional water and partitioned between water/hexanes. The organics were washed with brine, dried over sodium sulfate, filtered and evaporated in vacuo. Purification by flash chromatography (0-40% MTBE/hexanes) gave α,β-unsaturated amide vi. ¹H NMR (400 MHz, CDCl₃) δ 5.75 (s, 1H), 5.36 (m, 4H), 3.01 (s, 3H), 2.99 (s, 3H), 2.78 (t, 2H), 2.28 (t, 2H), 2.05 (m, 6H), 1.35 (m, 34H), 0.89 (m, 6H).

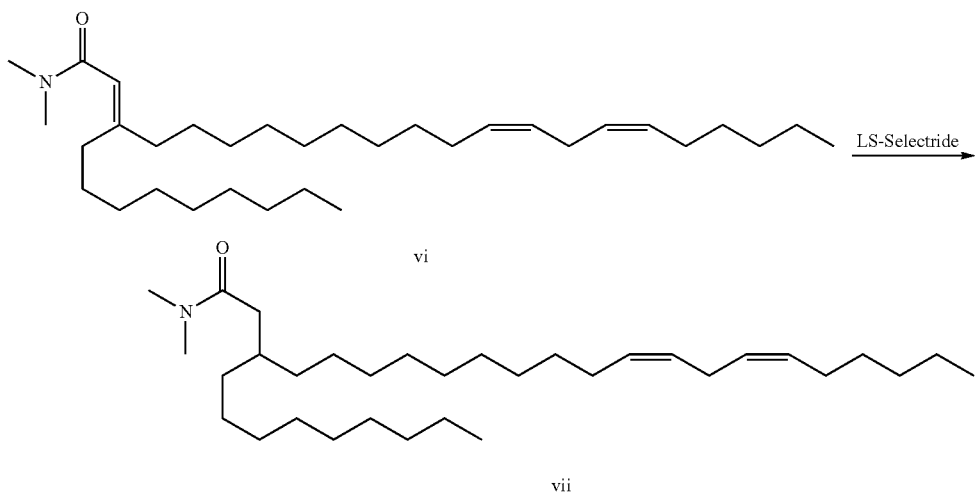

α,β-unsaturated amide vi (1 g, 2.1 mmol) and LS-Selectride (4.1 mmol, 4.1 mL of a 1M solution) were combined in a sealed tube and heated to 60° C. for 24 hours. The reaction was cooled to ambient temperature and partitioned between ammonium chloride solution and heptane. The organics were dried over sodium sulfate, filtered and evaporated in vacuo to give amide vii. This intermediate was carried directly into next reaction crude.

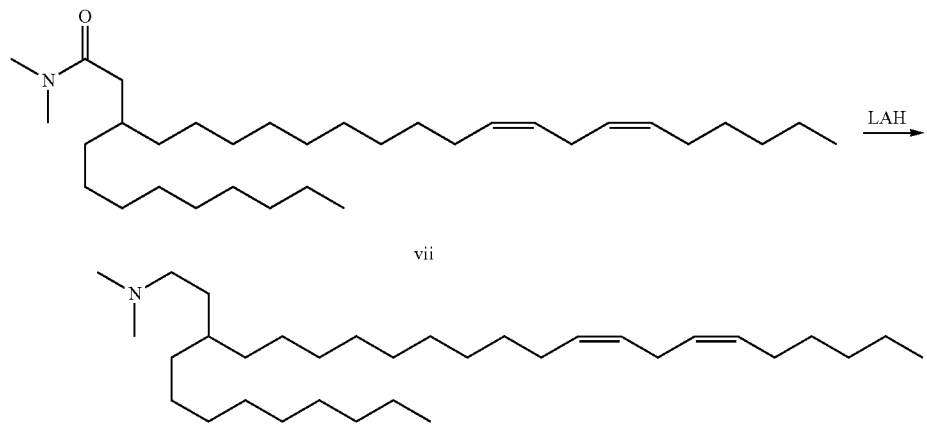

To a solution of amide vii (2.85 g, 5.8 mmol) was added lithium aluminum hydride (8.7 mmol, 8.7 mL of a 1M solution). The reaction was stirred at ambient temperature for 10 minutes then quenched by slow addition of sodium sulfate decahydrate solution. The solids were filtered and washed with THF and the filtrate evaporated in vacuo. The crude mixture was purified by reverse phase preparative chromatography (C8 column) to provide (13Z,16Z)—N,N-dimethyl-3-nonyldocosa-13,16-dien-1-amine (Compound 32) as an oil. HRMS (M+H) calc'd 476.5190. found 476.5189. $^1$H NMR (400 MHz, CDCl$_3$) δ 5.37 (m, 4H), 2.78 (t, 2H), 2.42 (m, 8H), 2.05 (q, 4H), 1.28 (m, 41H), 0.89 (m, 6H).

N,N-dimethyl-1-(2-octylcyclopropyl)heptadecan-8-amine (Compound 33)

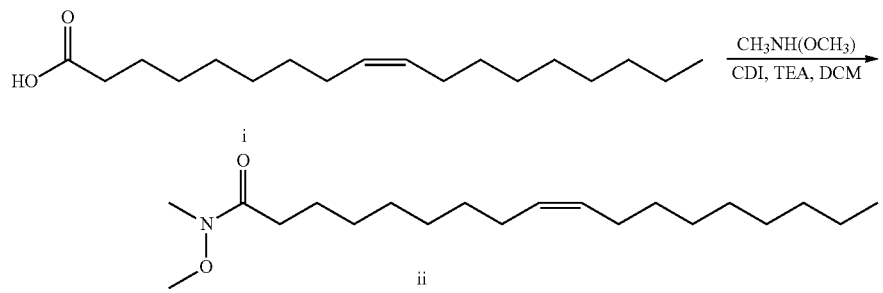

To a solution of oleic acid (1 g, 3.5 mmol) in DCM (500 mL) cooled to 0° C. was added CDI (0.63 g, 3.9 mmol). The reaction was warmed to ambient temperature for 30 minutes before cooling to 0° C. and treating first with triethylamine (0.39 g, 3.9 mmol) and then dimethyl hydroxylamine hydrochloride (0.38 g, 3.9 mmol). After 1 hour the reaction was partitioned between water and heptane. The organics were dried over magnesium sulfate, filtered and evaporate in vacuo to give crude Weinreb amide ii which was carried directly into next reaction.

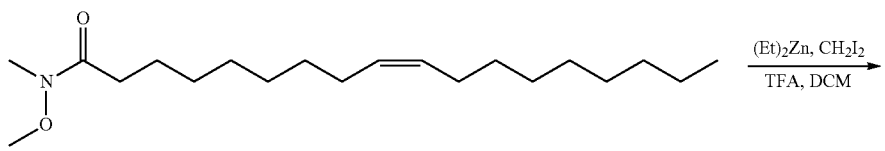

A solution of diethylzinc (70.3 mmol, 70.3 mL of a 1M solution) in dichloromethane (130 mL) was cooled to −1° C. and treated dropwise with TFA (8.0 g, 70.3 mmol). After 30 minutes, diiodomethane (18.8 g, 70.3 mmol) was added and this was aged for 30 minutes in the ice bath. To this solution was added Weinreb amide ii (7.6 g, 23.4 mmol). The reaction was warmed to ambient temperature and stirred for 1 hour. The reaction was quenched with ammonium chloride solution (100 mL) and organic layer partitioned off, washed with 10% sodium thiosulfate, dried over magnesium sulfate, filtered and evaporated in vacuo. Purification was flash chromatography (0-30% MTBE/heptane) gave desired product ix. $^1$H NMR (400 MHz, CDCl$_3$) δ 3.72 (s, 3H), 3.22 (s, 3H), 2.48 (t, 2H), 1.65 (m, 2H), 1.39 (m, 22H), 1.18 (m, 2H), 0.91 (t, 3H), 0.68 (m, 2H), 0.59 (m, 1H), −0.32 (m, 1H).

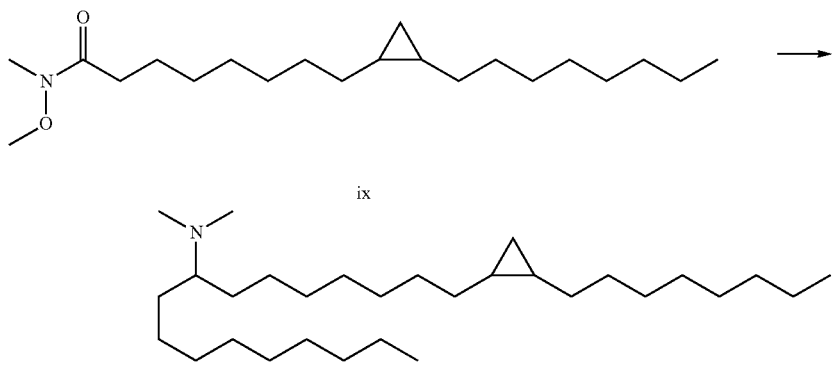

Conversion of Weinreb amide ix to Compound 33 was carried out in a manner analogous to that described for Compound 1 above (nonyl Grignard addition followed by reductive amination). LC/MS (M+H)=436.6. $^1$H NMR (400 MHz, CDCl$_3$) δ 2.25 (s, 6H), 1.30 (m, 45H), 0.91 (m, 6H), 0.68 (m, 2H), 0.59 (m, 1H), −0.31 (m, 1H).

Compounds 34-43 are novel cationic lipids and were prepared according to General Schemes 1-4 above.

| Compound | Structure | HRMS |
|---|---|---|
| 34 | 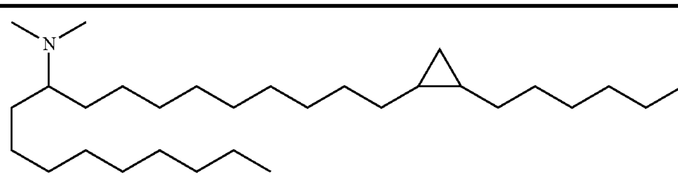 | calcd C30H62N 436.4877, found 436.4872. |

331 332

-continued

| Compound | Structure | HRMS |
|---|---|---|
| 35 | 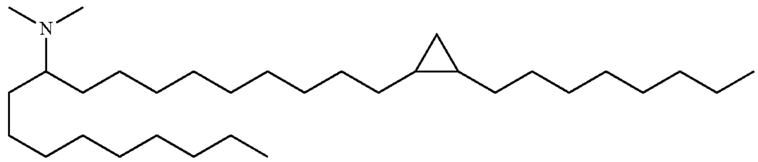 [SMILES: CCCCCCCCCC(CCCCCCCCCC1CC1CCCCCCCC)N(C)C] | calcd C32H66N 464.5190, found 464.5186. |
| 36 | 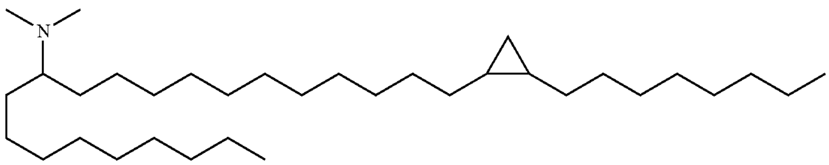 [SMILES: CCCCCCCCCC(CCCCCCCCCCCC1CC1CCCCCCCC)N(C)C] | calcd C34H70N 492.5503, found 492.5496. |
| 37 | 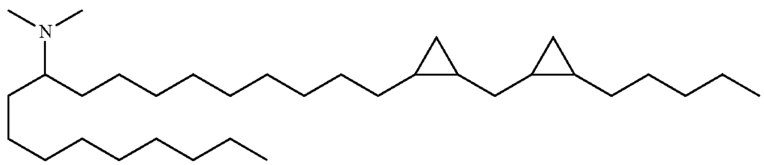 [SMILES: CCCCCCCCCC(CCCCCCCCCC1CC1CC1CC1CCCCC)N(C)C] | calcd C33H66N 476.5190, found 476.5174. |
| 38 | 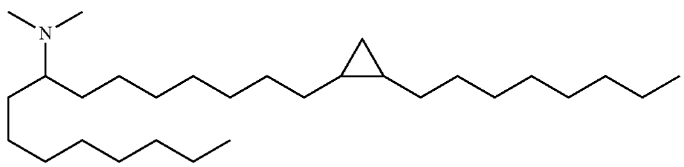 [SMILES: CCCCCCCCC1CC1CCCCCCCC(CCCCCCCC)N(C)C] | calcd C29H60N 422.4720, found 422.4701. |
| 39 | 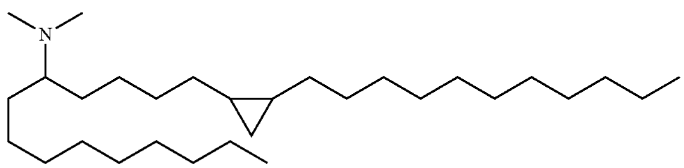 [SMILES: CCCCCCCCCCCC1CC1CCCCC(CCCCCCCCC)N(C)C] | calcd C30H62N 436.4877, found 436.4880. |
| 40 | 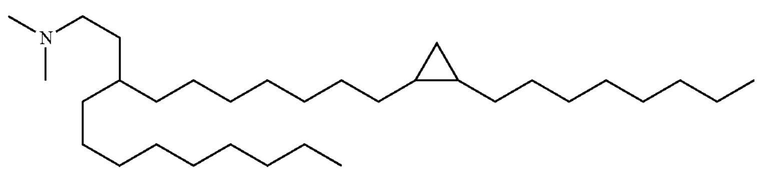 [SMILES: CCCCCCCCCC(CCCCCCCC1CC1CCCCCCCC)CCN(C)C] | calcd C32H66N 464.5190, found 464.5199. |
| 41 | 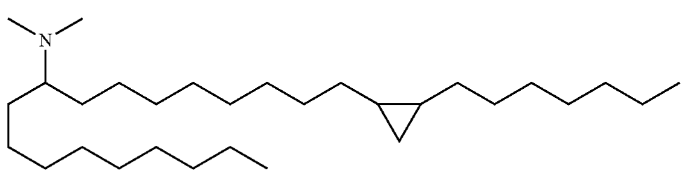 [SMILES: CCCCCCCCCC(CCCCCCCCC1CC1CCCCCCC)N(C)C] | calcd C30H62N 436.4877, found 436.4877. |
| 42 | 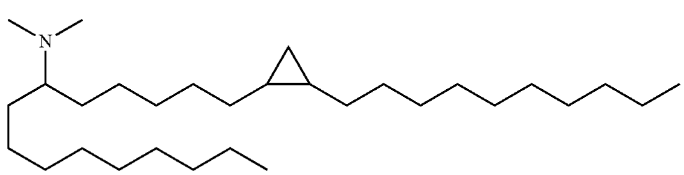 [SMILES: CCCCCCCCCCC1CC1CCCCCC(CCCCCCCCC)N(C)C] | calcd C30H62N 436.4877, found 436.4875. |
| 43 | 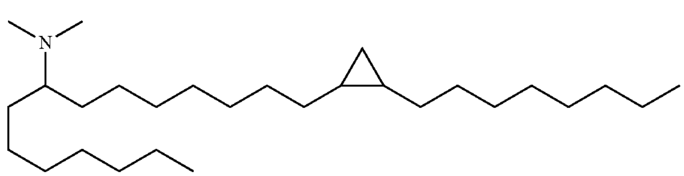 [SMILES: CCCCCCCCC1CC1CCCCCCCC(CCCCCCC)N(C)C] | LC/MS (M + H) 408.6. |

(11E,20Z,23Z)—N,N-dimethylnonacosa-11,20,23-trien-10-amine (Compound 44)

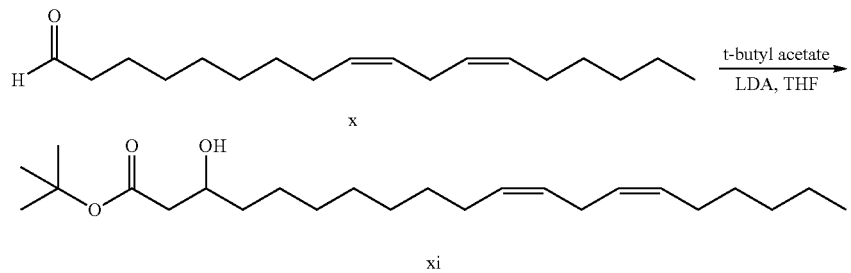

To a solution of LDA (95 mmol, 47.5 mL of a 2M solution) in THF (127 mL) cooled to −78° C. was added t-butyl acetate. The reaction was stirred for 15 minutes followed by addition of aldehyde x. The reaction was immediately quenched with ammonium chloride solution, warmed to ambient temperature and partitioned between water/pentane. The organics were dried over sodium sulfate, filtered and evaporated in vacuo. LC/MS (M+H-tBu)=325.4.

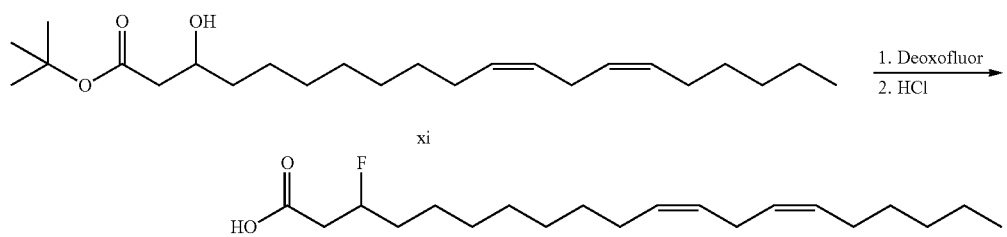

Hydroxy ketone xi (7 g, 18.4 mmol) was dissolved in dichloromethane (150 mL) and cooled to 0° C. and treated with deoxofluor (7.3 g, 33.1 mmol). The reaction was warmed to ambient temperature with stirring for 16 hours followed by quenching with sodium bicarbonate solution. The reaction was partitioned and the organics dried over sodium sulfate, filtered and evaporate in vacuo. Flash column chromatography (0-5% ethyl acetate/hexanes) gave the -fluoro ester.

Fluoro ester intermediate (6 g, 15.6 mmol) in dichloromethane was treated with hydrogen chloride (157 mmol, 39.2 mL of a 4M solution in dioxane) and the reaction was stirred at ambient temperature for 16 hours. The reaction was evaporated in vacuo to give desired β-fluoro acid xii. LC/MS (M+H)=327.3.

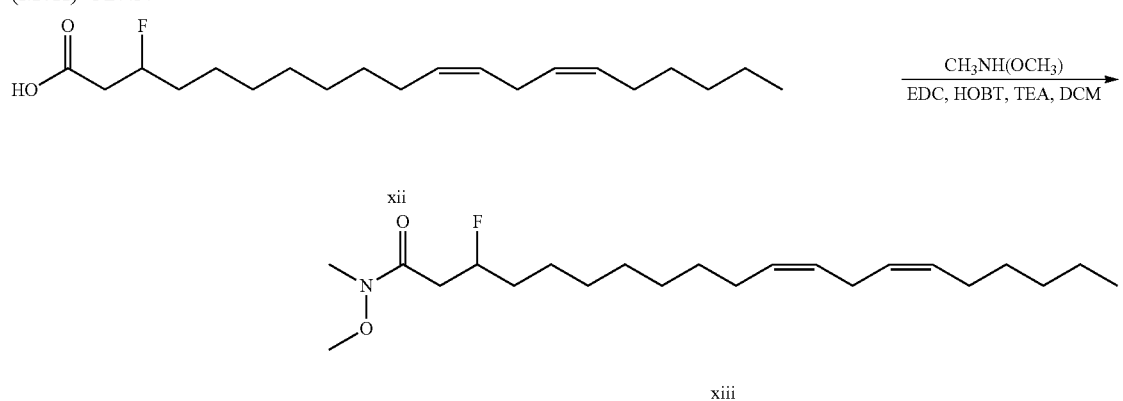

Fluoro carboxylic acid xii (5.1 g, 15.7 mmol), EDC (6.0 g, 31.4 mmol), N,O-dimethylhydroxylamine hydrochloride (3.1 g, 31.4 mmol), trimethylamine (4.0 g, 39.2 mmol), and HOAt (4.3 g, 31.4 mmol) were combined in DCM (78 mL) and stirred at ambient temperature for 16 hours. The reaction was partitioned between water/DCM and the organics were washed with water (3×) and NaOH solution (1×), dried over sodium sulfate, filtered and evaporated in vacuo. Crude material was purified by reverse phase preparative chromatography to give desired Weinreb amide xiii LC/MS (M+H)= 370.4.

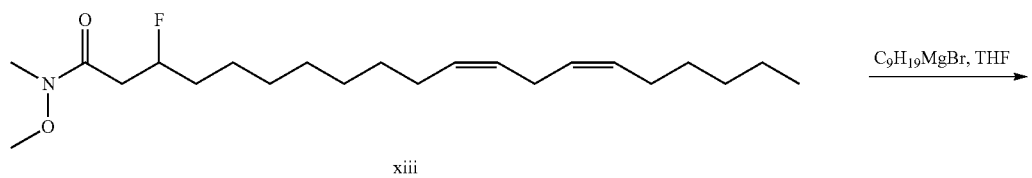

xiii

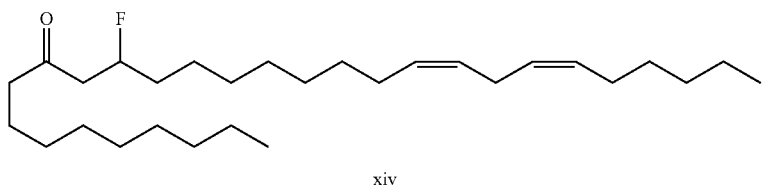

xiv

A solution of Weinreb amide xiii (4.3 g, 11.7 mmol) in THF (50 mL) was treated with nonylmagnesium bromide (23.4 mmol, 23.4 mL of a 1M solution) at ambient temperature. The reaction was quenched with ammonium chloride solution after 1 hour and partitioned between water and pentane. The organics were dried over sodium sulfate, filtered and evaporated in vacuo. This material was carried into next step crude.

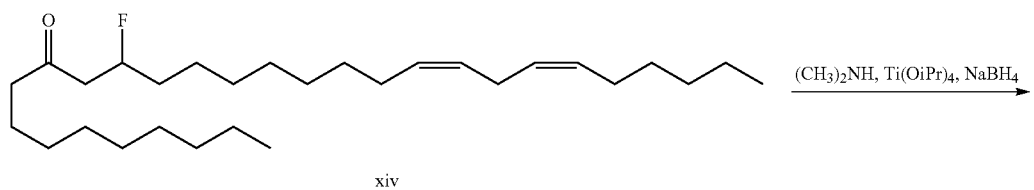

xiv

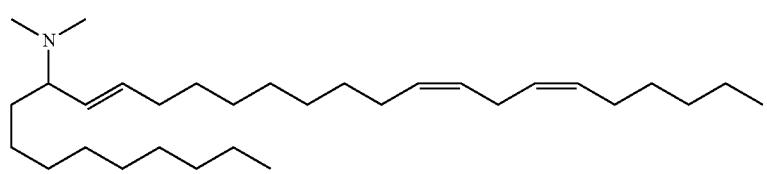

44

Ketone xiv (5.1 g, 11.7 mmol) was treated with dimethylamine (29.3 mmol, 14.7 mL of a 2M solution in THF) and titanium(IV) isopropoxide (6.7 g, 23.5 mmol) and the reaction was stirred at ambient temperature for 16 hours. To the reaction mixture was added ethanol (50 mL) followed by sodium borohydride (0.67 g, 17.6 mmol). The reaction was loaded directly onto a silica column and purified by flash chromatography (0-15% MeOH/DCM). The material required a second purification by preparative reverse phase chromatography to give (11E,20Z,23Z)—N,N-dimethyl-nonacosa-11,20,23-trien-10-amine. HRMS calc'd 446.4720. found 446.4724. $^1$H NMR (400 MHz, CDCl$_3$) δ 5.48 (m, 1H), 5.37 (m, 4H), 5.23 (m, 1H), 2.78 (t, 2H), 2.58 (m, 1H), 2.22 (s, 6H), 2.04 (m, 6H), 1.56 (m, 1H), 1.30 (m, 31H), 0.89 (m, 6H).

Compound 45 is DLinKC2DMA as described in *Nature Biotechnology*, 2010, 28, 172-176, WO 2010/042877 A1, WO 2010/048536 A2, WO 2010/088537 A2, and WO 2009/127060 A1.

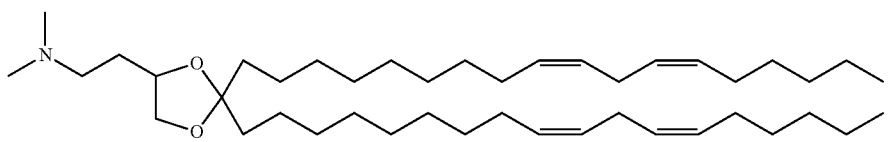

(45)

Compound 46 is MC3 as described in WO 2010/054401, and WO 2010/144740 A1.

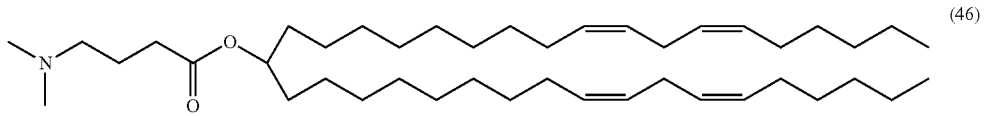

(46)

D. Lipid Nanoparticle Compositions

The following lipid nanoparticle compositions (LNPs) of the instant invention are useful for the delivery of oligonucleotides, specifically siNA molecules of the invention:
Cationic Lipid/Cholesterol/PEG-DMG 56.6/38/5.4;
Cationic Lipid/Cholesterol/PEG-DMG 60/38/2;
Cationic Lipid/Cholesterol/PEG-DMG 67.3/29/3.7;
Cationic Lipid/Cholesterol/PEG-DMG 49.3/47/3.7;
Cationic Lipid/Cholesterol/PEG-DMG 50.3/44.3/5.4;
Cationic Lipid/Cholesterol/PEG-C-DMA/DSPC 40/48/2/10;
Cationic Lipid/Cholesterol/PEG-DMG/DSPC 40/48/2/10; and
Cationic Lipid/Cholesterol/PEG-DMG/DSPC 58/30/2/10.

One skilled in the art would readily appreciate that the present invention is well adapted to carry out the objects and obtain the ends and advantages mentioned, as well as those inherent therein. The methods and compositions described herein, as presently representative of preferred embodiments, are exemplary and are not intended as limitations on the scope of the invention. Changes therein and other uses will occur to those skilled in the art, which are encompassed within the spirit of the invention, are defined by the scope of the claims.

TABLE 8

| CTNNB1 Accession Numbers |
| --- |
| NM_001098210 |
| *Homo sapiens* catenin (cadherin-associated protein), beta 1, 88 kDa, (CTNNB1), transcriptvariant 3, mRNA. |
| NM_001098210.1 GI:148227671 |
| NM_007614 |
| *Mus musculus* catenin (cadherin associated protein), beta 1(Ctnnb1), transcript variant 1, mRNA |
| NM_007614.2 GI:31560726 |
| XM_001115474 |
| *Macaca mulatta* catenin (cadherin-associated protein),beta 1, 88 kDa, transcript variant (CTNNB1), mRNA. |
| XM_001115474.1 GI:109041278 |

TABLE 9

Non-limiting examples of Stabilization Chemistries for chemically modified siNA constructs Non-limiting examples of Stabilization Chemistries for chemically modified siNA constructs

| Chemistry | pyrimidine | purine | caps | p = S | Strand |
| --- | --- | --- | --- | --- | --- |
| "Stab 00" | Ribo | Ribo | TT at 3' ends | — | S/AS |
| "Stab 1" | Ribo | Ribo | — | 5 at 5'-end 1 at 3'-end | S/AS |
| "Stab 2" | Ribo | Ribo | — | All linkages | Usually AS |
| "Stab 3" | 2'-fluoro | Ribo | — | 4 at 5'-end 4 at 3'-end | Usually S |
| "Stab 4" | 2'-fluoro | Ribo | 5' and 3'- ends | — | Usually S |
| "Stab 5" | 2'-fluoro | Ribo | — | 1 at 3'-end | Usually AS |
| "Stab 6" | 2'-O-Methyl | Ribo | 5' and 3'- ends | — | Usually S |
| "Stab 7" | 2'-fluoro | 2'-deoxy | 5' and 3'- ends | — | Usually S |
| "Stab 8" | 2'-fluoro | 2'-O-Methyl | — | 1 at 3'-end | S/AS |
| "Stab 9" | Ribo | Ribo | 5' and 3'- ends | — | Usually S |
| "Stab 10" | Ribo | Ribo | — | 1 at 3'-end | Usually AS |
| "Stab 11" | 2'-fluoro | 2'-deoxy | — | 1 at 3'-end | Usually AS |
| "Stab 12" | 2'-fluoro | LNA | 5' and 3'- ends | — | Usually S |
| "Stab 13" | 2'-fluoro | LNA | — | 1 at 3'-end | Usually AS |
| "Stab 14" | 2'-fluoro | 2'-deoxy | — | 2 at 5'-end 1 at 3'-end | Usually AS |

TABLE 9-continued

Non-limiting examples of Stabilization Chemistries for chemically modified siNA constructs
Non-limiting examples of Stabilization Chemistries for chemically modified siNA constructs

| Chemistry | pyrimidine | purine | caps | p = S | Strand |
|---|---|---|---|---|---|
| "Stab 15" | 2'-deoxy | 2'-deoxy | | 2 at 5'-end 1 at 3'-end | Usually AS |
| "Stab 16" | Ribo | 2'-O-Methyl | 5' and 3'-ends | | Usually S |
| "Stab 17" | 2'-O-Methyl | 2'-O-Methyl | 5' and 3'-ends | | Usually S |
| "Stab 18" | 2'-fluoro | 2'-O-Methyl | 5' and 3'-ends | | Usually S |
| "Stab 19" | 2'-fluoro | 2'-O-Methyl | 3'-end | | S/AS |
| "Stab 20" | 2'-fluoro | 2'-deoxy | 3'-end | | Usually AS |
| "Stab 21" | 2'-fluoro | Ribo | 3'-end | | Usually AS |
| "Stab 22" | Ribo | Ribo | 3'-end | | Usually AS |
| "Stab 23" | 2'-fluoro* | 2'-deoxy* | 5' and 3'-ends | | Usually S |
| "Stab 24" | 2'-fluoro* | 2'-O-Methyl* | — | 1 at 3'-end | S/AS |
| "Stab 25" | 2'-fluoro* | 2'-O-Methyl* | — | 1 at 3'-end | S/AS |
| "Stab 26" | 2'-fluoro* | 2'-O-Methyl* | — | | S/AS |
| "Stab 27" | 2'-fluoro* | 2'-O-Methyl* | 3'-end | | S/AS |
| "Stab 28" | 2'-fluoro* | 2'-O-Methyl* | 3'-end | | S/AS |
| "Stab 29" | 2'-fluoro* | 2'-O-Methyl* | | 1 at 3'-end | S/AS |
| "Stab 30" | 2'-fluoro* | 2'-O-Methyl* | | | S/AS |
| "Stab 31" | 2'-fluoro* | 2'-O-Methyl* | 3'-end | | S/AS |
| "Stab 32" | 2'-fluoro | 2'-O-Methyl | | | S/AS |
| "Stab 33" | 2'-fluoro | 2'-deoxy* | 5' and 3'-ends | — | Usually S |
| "Stab 34" | 2'-fluoro | 2'-O-Methyl* | 5' and 3'-ends | | Usually S |
| "Stab 35" | 2'-fluoro*† | 2'-O-Methyl*† | | | Usually AS |
| "Stab 36" | 2'-fluoro*† | 2'-O-Methyl*† | | | Usually AS |
| "Stab04H" | 2'-fluoro‡ | Ribo‡ | 5' and 3'-ends | 1 at 3'-end | Ususally S |
| "Stab06C" | 2'-O-Methyl‡ | Ribo‡ | 5' and 3'-ends | | Ususally S |
| "Stab07H" | 2'-fluoro‡ | 2'-deoxy‡ | 5' and 3'-ends | 1 at 3'-end | Ususally S |
| "Stab07mU" | 2'-fluoro‡ | 2'-deoxy‡ | 5' and 3'-ends | | Ususally S |
| "Stab09H" | Ribo‡ | Ribo‡ | 5' and 3'-ends | 1 at 3'-end | Ususally S |
| "Stab16C" | Ribo‡ | 2'-O-Methyl‡ | 5' and 3'-ends | | Ususally S |
| "Stab16H" | Ribo‡ | 2'-O-Methyl‡ | 5' and 3'-ends | 1 at 3'-end | Ususally S |
| "Stab18C" | 2'-fluoro‡ | 2'-O-Methyl‡ | 5' and 3'-ends | | Ususally S |
| "Stab18H" | 2'-fluoro‡ | 2'-O-Methyl‡ | 5' and 3'-ends | 1 at 3'-end | Ususally S |
| "Stab52H" | 2'-O-Methyl‡ | Ribo‡ | 5' and 3'-ends | 1 at 3'-end | Ususally S |
| "Stab05C" | 2'-fluoro‡ | Ribo‡ | | | Ususally AS |
| "Stab05N" | 2'-fluoro‡ | Ribo‡ | | 1 at 3'-end | Ususally AS |
| "Stab10C" | Ribo‡ | Ribo‡ | | | Ususally AS |
| "Stab10N" | Ribo‡ | Ribo‡ | | 1 at 3'-end | Ususally AS |
| "Stab35G*" | 2'-fluoro‡ | 2'-O-Methyl‡ | | | Ususally AS |
| "Stab35N*" | 2'-fluoro‡ | 2'-O-Methyl‡ | | 1 at 3'-end | Ususally AS |
| "Stab35rev" | 2'-O-Methyl‡ | 2'-fluoro‡ | | | Ususally AS |
| "Stab50" | Ribo‡ | 2'-O-Methyl‡ | | | Ususally AS |
| "Stab53*" | 2'-O-Methyl‡ | Ribo‡ | | | Ususally AS |

TABLE 9-continued

Non-limiting examples of Stabilization Chemistries for chemically modified siNA constructs Non-limiting examples of Stabilization Chemistries for chemically modified siNA constructs

| Chemistry | pyrimidine | purine | caps | p = S | Strand |
|---|---|---|---|---|---|
| "Stab53N*" | 2'-O-Methyl‡ | Ribo‡ | | 1 at 3'-end | Ususally AS |
| Stab54 | Ribo‡ | 2'-fluoro‡ | | | Ususally AS |

CAP = any terminal cap, see for example FIG. 6.
All Stab chemistries can be used in combination with each other for duplexes of the invention (e.g., as combinations of sense and antisense strand chemistries), or alternately can be used in isolation, e.g., for single stranded nucleic acid molecules of the invention.
All Stab chemistries can comprise 3'-overhang nucleotides having 2'-O-alkyl, 2'-deoxy-2'-fluoro, 2'-deoxy, LNA or other modified nucleotides or non-nucleotides.
All Stab chemistries typically comprise about 19-21 nucleotides, but can vary as described herein.
All Stab chemistries can also include a single ribonucleotide in the sense or passenger strand at the 11$^{th}$ base paired position of the double-stranded nucleic acid duplex as determined from the 5'-end of the antisense or guide strand.
All Stab chemistries can also have in place of the Stab designation above a 2'-deoxy-2'-fluoro modification at position 14 from the 5' end of the antisense strand regardless of whether it is a purine or pyrimidine at that position.
All Stab chemistries of the antisense strand presented above can have a thymidine in place of a 2'-deoxy uridine at position 1, 2, and/or 3 from the 5' end of the antisense strand.
S = sense strand.
AS = antisense strand
*Stab 23 has a single ribonucleotide adjacent to 3'-CAP.
*Stab 24 and Stab 28 have a single ribonucleotide at 5'-terminus
*Stab 25, Stab 26, Stab 27, Stab 35, Stab 35G*, Stab 35N*, Stab 35rev*, Stab 36, Stab 50*, Stab53*, Stab 53N*, and Stab 54 have three ribonucleotides at 5'-terminus.
*Stab 29, Stab 30, Stab 31, Stab 33, and Stab 34 any purine at first three nucleotide positions from 5'-terminus are ribonucleotides.
p = phosphorothioate linkage.
†Stab 35 has 2'-O-methyl U at 3'-overhangs and three ribonucleotides at 5'-terminus
†Stab 36 has 2'-O-methyl overhangs that are complementary to the target sequence. (naturally occurring overhangs) and three ribonucleotides at 5'-terminus
‡ - Stab 04H, Stab 06C, Stab107H, Stab07mU, Stab09H, Stab16C, Stab 16H, Stab18C, Stab 18H, Stab 52H, Stab 05C, Stab05N, Stab10C, Stab10N, Stab35G*, Stab35N*, Stab35rev*, Stab 50*, Stab 53*, Stab 53N*, Stab 54 have two 2'-O-methyl U 3'-overhangs.
Stab35G*, Stab 35N*, Stab35rev*, Stab50*, Stab53*, and Stab53N* do not allow for a 2'-O-methyl modification at position 14 of the guide strand as determined from the 5'-end.

TABLE 10

Exemplary Solid Phase Oligonucleotide Synthsis Conditions

A. 2.5 µmol Synthesis Cycle ABI 394 Instrument

| Reagent | Equivalents | Amount | Wait Time* DNA | Wait Time* 2'-O-methyl | Wait Time*RNA |
|---|---|---|---|---|---|
| Phosphoramidites | 6.5 | 163 µL | 45 sec | 2.5 min | 7.5 min |
| S-Ethyl Tetrazole | 23.8 | 238 µL | 45 sec | 2.5 min | 7.5 min |
| Acetic Anhydride | 100 | 233 µL | 5 sec | 5 sec | 5 sec |
| N-CTNNB1hyl Imidazole | 186 | 233 µL | 5 sec | 5 sec | 5 sec |
| TCA | 176 | 2.3 mL | 21 sec | 21 sec | 21 sec |
| Iodine | 11.2 | 1.7 mL | 45 sec | 45 sec | 45 sec |
| Beaucage | 12.9 | 645 µL | 100 sec | 300 sec | 300 sec |
| Acetonitrile | NA | 6.67 mL | NA | NA | NA |

B. 0.2 µmol Synthesis Cycle ABI 394 Instrument

| Reagent | Equivalents | Amount | Wait Time* DNA | Wait Time* 2'-O-methyl | Wait Time*RNA |
|---|---|---|---|---|---|
| Phosphoramidites | 15 | 31 µL | 45 sec | 233 sec | 465 sec |
| S-Ethyl Tetrazole | 38.7 | 31 µL | 45 sec | 233 min | 465 sec |
| Acetic Anhydride | 655 | 124 µL | 5 sec | 5 sec | 5 sec |
| N-CTNNB1hyl Imidazole | 1245 | 124 µL | 5 sec | 5 sec | 5 sec |
| TCA | 700 | 732 µL | 10 sec | 10 sec | 10 sec |
| Iodine | 20.6 | 244 µL | 15 sec | 15 sec | 15 sec |
| Beaucage | 7.7 | 232 µL | 100 sec | 300 sec | 300 sec |
| Acetonitrile | NA | 2.64 mL | NA | NA | NA |

TABLE 10-continued

Exemplary Solid Phase Oligonucleotide Synthsis Conditions

C. 0.2 µmol Synthesis Cycle 96 well Instrument

| Reagent | Equivalents DNA/2'-O-methyl/Ribo | Amount: DNA/2'-O-methyl/Ribo | Wait Time* DNA | Wait Time* 2'-O-methyl | Wait Time* Ribo |
|---|---|---|---|---|---|
| Phosphoramidites | 22/33/66 | 40/60/120 µL | 60 sec | 180 sec | 360 sec |
| S-Ethyl Tetrazole | 70/105/210 | 40/60/120 µL | 60 sec | 180 min | 360 sec |
| Acetic Anhydride | 265/265/265 | 50/50/50 µL | 10 sec | 10 sec | 10 sec |
| N-CTNNB1hyl Imidazole | 502/502/502 | 50/50/50 µL | 10 sec | 10 sec | 10 sec |
| TCA | 238/475/475 | 250/500/500 µL | 15 sec | 15 sec | 15 sec |
| Iodine | 6.8/6.8/6.8 | 80/80/80 µL | 30 sec | 30 sec | 30 sec |
| Beaucage | 34/51/51 | 80/120/120 | 100 sec | 200 sec | 200 sec |
| Acetonitrile | NA | 1150/1150/1150 µL | NA | NA | NA |

Wait time does not include contact time during delivery.
Tandem synthesis utilizes double coupling of linker molecule

TABLE 11

Composition of Select Lipid Nanoparticle Formulations

| LNP Identifier | Lipid Components and Molar Ratios | | | | siNA Duplex | N/P |
|---|---|---|---|---|---|---|
| LNP-1 | Compound 32 (50%) | Cholesterol (30%) | DSPC (10%) | PEG-DMG (2%) | R-008488889-000M | 6 |
| LNP-2 | Compound 32 (50%) | Cholesterol (30%) | DSPC (10%) | PEG-DMG (2%) | R-008488882-000B | 6 |
| LNP-3 | Compound 32 (50%) | Cholesterol (30%) | DSPC (10%) | PEG-DMG (2%) | R-008380929-000H | 6 |
| LNP-4 | Compound 32 (50%) | Cholesterol (30%) | DSPC (10%) | PEG-DMG (2%) | R-008488885-000C | 6 |

N/P ratio = Nitrogen:Phosphorous ratio between cationic lipid and nucleic acid

TABLE 12

Chemical Structures of Lipids in Formulations of Table 11

| Lipid | Chemical Structure |
|---|---|
| Compound 32 | 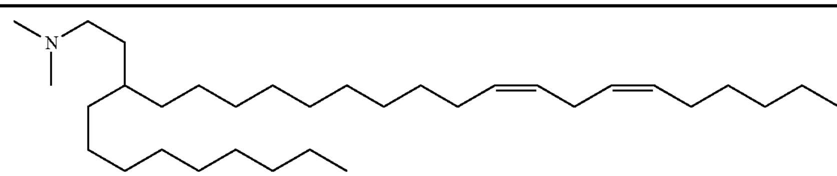 |
| Cholesterol | 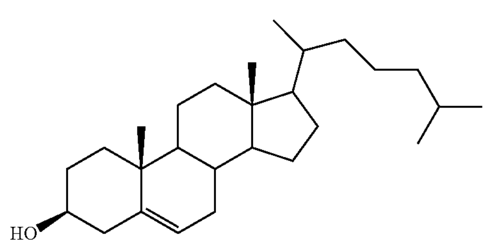 [SMILES: CC(C)CCCC(C)C1CCC2C3CC=C4C[C@@H](O)CC[C@]4(C)C3CC[C@]12C] |
| DSPC | 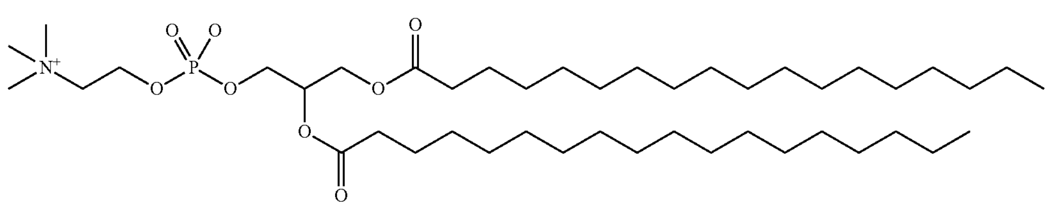 [SMILES: CCCCCCCCCCCCCCCCCC(=O)OCC(COP(=O)(O)OCC[N+](C)(C)C)OC(=O)CCCCCCCCCCCCCCCCC] |

TABLE 12-continued

Chemical Structures of Lipids in Formulations of Table 11

| Lipid | Chemical Structure |
|---|---|
| PEG-DMG | 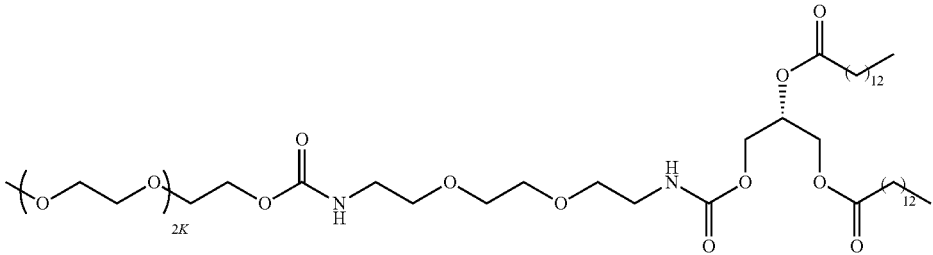 |

SEQUENCE LISTING (6374 sequences)

SEQ ID NO: 1 - RNA, 19 nt, Artificial Sequence
  Synthetic
ucgagcucagaggguacga

SEQ ID NO: 2 - RNA, 19 nt, Artificial Sequence
  Synthetic
gaggcucuugugcguacug

SEQ ID NO: 3 - RNA, 19 nt, Artificial Sequence
  Synthetic
gcccagaaugcaguucgcc

SEQ ID NO: 4 - RNA, 19 nt, Artificial Sequence
  Synthetic
cgagcucagaggguacgag

SEQ ID NO: 5 - RNA, 19 nt, Artificial Sequence
  Synthetic
cuguuggauugauucgaaa

SEQ ID NO: 6 - RNA, 19 nt, Artificial Sequence
  Synthetic
gucugcuauuguacguacc

SEQ ID NO: 7 - RNA, 19 nt, Artificial Sequence
  Synthetic
aauucuuggcuauuacgac

SEQ ID NO: 8 - RNA, 19 nt, Artificial Sequence
  Synthetic
ggauguucacaaccgaauu

SEQ ID NO: 9 - RNA, 19 nt, Artificial Sequence
  Synthetic
acaguaugcaaugacucga

SEQ ID NO: 10 - RNA, 19 nt, Artificial Sequence
  Synthetic
agcuuccagacacgcuauc

SEQ ID NO: 11 - RNA, 19 nt, Artificial Sequence
  Synthetic
ugucugcuauuguacguac

SEQ ID NO: 12 - RNA, 19 nt, Artificial Sequence
  Synthetic
acuguuggauugauucgaa

SEQ ID NO: 13 - RNA, 19 nt, Artificial Sequence
  Synthetic
caggauacccagcgccgua

SEQ ID NO: 14 - RNA, 19 nt, Artificial Sequence
  Synthetic
gacacgcuaucaugcguuc

SEQ ID NO: 15 - RNA, 19 nt, Artificial Sequence
  Synthetic
uacuguuggauugauucga

SEQ ID NO: 16 - RNA, 19 nt, Artificial Sequence
  Synthetic
uucuuggcuauuacgacag

SEQ ID NO: 17 - RNA, 19 nt, Artificial Sequence
  Synthetic
acacgcuaucaugcguucu

SEQ ID NO: 18 - RNA, 19 nt, Artificial Sequence
  Synthetic
cagacacgcuaucaugcgu

SEQ ID NO: 19 - RNA, 19 nt, Artificial Sequence
  Synthetic
uguuggauugauucgaaau

SEQ ID NO: 20 - RNA, 19 nt, Artificial Sequence
  Synthetic
cagauccaagucaacgucu

SEQ ID NO: 21 - RNA, 19 nt, Artificial Sequence
  Synthetic
aggcucuugugcguacugu

SEQ ID NO: 22 - RNA, 19 nt, Artificial Sequence
  Synthetic
gcguacuguccuucgggcu

SEQ ID NO: 23 - RNA, 19 nt, Artificial Sequence
  Synthetic
acuaauguccagcguuugg

SEQ ID NO: 24 - RNA, 19 nt, Artificial Sequence
  Synthetic
cacauccuagcucgggaug

SEQ ID NO: 25 - RNA, 19 nt, Artificial Sequence
  Synthetic
guugcugagagggcucgag

SEQ ID NO: 26 - RNA, 19 nt, Artificial Sequence
  Synthetic
caucugaccagccgacacc

SEQ ID NO: 27 - RNA, 19 nt, Artificial Sequence
  Synthetic
ugcguacuguccuucgggc

SEQ ID NO: 28 - RNA, 19 nt, Artificial Sequence
  Synthetic
acaagauuacaagaaacgg

SEQ ID NO: 29 - RNA, 19 nt, Artificial Sequence
  Synthetic
guuguaaacuugauuaacu

SEQ ID NO: 30 - RNA, 19 nt, Artificial Sequence
  Synthetic
uaaacuugauuaacuauca

SEQ ID NO: 31 - RNA, 19 nt, Artificial Sequence
  Synthetic
auauaaugaggaccuauac

SEQ ID NO: 32 - RNA, 19 nt, Artificial Sequence
  Synthetic
aaacuugauuaacuaucaa

SEQ ID NO: 33 - RNA, 19 nt, Artificial Sequence
  Synthetic
gaaauaguugaagguugua

SEQ ID NO: 34 - RNA, 19 nt, Artificial Sequence
  Synthetic
auaaugaggaccuauacuu

SEQ ID NO: 35 - RNA, 19 nt, Artificial Sequence
  Synthetic
uuaaauucuuggcuauuac

SEQ ID NO: 36 - RNA, 19 nt, Artificial Sequence
  Synthetic
uguaaacuugauuaacuau

SEQ ID NO: 37 - RNA, 19 nt, Artificial Sequence
  Synthetic
guaaacuugauuaacuauc

SEQ ID NO: 38 - RNA, 19 nt, Artificial Sequence
  Synthetic
uuguaaacuugauuaacua

SEQ ID NO: 39 - RNA, 19 nt, Artificial Sequence
  Synthetic
gcuuuaguaaauauaauga

SEQ ID NO: 40 - RNA, 19 nt, Artificial Sequence
  Synthetic
uggccaccacccuggugcu

SEQ ID NO: 41 - RNA, 19 nt, Artificial Sequence
  Synthetic
cuuuaguaaauauaaugag

SEQ ID NO: 42 - RNA, 19 nt, Artificial Sequence
  Synthetic
uuuaguaaauauaaugagg

SEQ ID NO: 43 - RNA, 19 nt, Artificial Sequence
  Synthetic
guaaaucguccuuuaggua

SEQ ID NO: 44 - RNA, 19 nt, Artificial Sequence
  Synthetic
accucacuugcaauaauua

SEQ ID NO: 45 - RNA, 19 nt, Artificial Sequence
  Synthetic
uaccauuccauuguuugug

SEQ ID NO: 46 - RNA, 19 nt, Artificial Sequence
  Synthetic
uccaaagaguagcugcagg

SEQ ID NO: 47 - RNA, 19 nt, Artificial Sequence
  Synthetic
uauccaguugaugggcugc

SEQ ID NO: 48 - RNA, 19 nt, Artificial Sequence
  Synthetic
caugcagaauacaaaugau

SEQ ID NO: 49 - RNA, 19 nt, Artificial Sequence
  Synthetic
ccaaagaguagcugcaggg

SEQ ID NO: 50 - RNA, 19 nt, Artificial Sequence
  Synthetic
caccaucccacuggccucu

SEQ ID NO: 51 - RNA, 19 nt, Artificial Sequence
  Synthetic
accaugcagaauacaaaug

SEQ ID NO: 52 - RNA, 19 nt, Artificial Sequence
  Synthetic
aagacaucacugagccugc

SEQ ID NO: 53 - RNA, 19 nt, Artificial Sequence
  Synthetic
aaucagcuggccugguuug

SEQ ID NO: 54 - RNA, 19 nt, Artificial Sequence
  Synthetic
aaccucacuugcaauaauu

SEQ ID NO: 55 - RNA, 19 nt, Artificial Sequence
  Synthetic
accucauggaugggcugcc

SEQ ID NO: 56 - RNA, 19 nt, Artificial Sequence
  Synthetic
accauuccauuguuugugc

SEQ ID NO: 57 - RNA, 19 nt, Artificial Sequence
  Synthetic
ccaugcagaauacaaauga

SEQ ID NO: 58 - RNA, 19 nt, Artificial Sequence
  Synthetic
cuucgucaucugaccagcc

SEQ ID NO: 59 - RNA, 19 nt, Artificial Sequence
  Synthetic
cugugaacuugcucaggac

SEQ ID NO: 60 - RNA, 19 nt, Artificial Sequence
  Synthetic
agacaucacugagccugcc

SEQ ID NO: 61 - RNA, 19 nt, Artificial Sequence
  Synthetic
gagccaauggcuuggaaug

SEQ ID NO: 62 - RNA, 19 nt, Artificial Sequence
  Synthetic
acugagccugccaucugug

SEQ ID NO: 63 - RNA, 19 nt, Artificial Sequence
  Synthetic
auugaagcugagggagcca

SEQ ID NO: 64 - RNA, 19 nt, Artificial Sequence
  Synthetic
guuaugguccaucagcuuu

SEQ ID NO: 65 - RNA, 19 nt, Artificial Sequence
  Synthetic
aauguggucaccugugcag

SEQ ID NO: 66 - RNA, 19 nt, Artificial Sequence
  Synthetic
agcuggccugguuugauac

SEQ ID NO: 67 - RNA, 19 nt, Artificial Sequence
  Synthetic
uggcugaaccaucacagau

SEQ ID NO: 68 - RNA, 19 nt, Artificial Sequence
  Synthetic
cacccaccaucccacuggc

SEQ ID NO: 69 - RNA, 19 nt, Artificial Sequence
  Synthetic
caauggcuuggaaugagac

SEQ ID NO: 70 - RNA, 19 nt, Artificial Sequence
  Synthetic
uggaccacaagcagagugc

SEQ ID NO: 71 - RNA, 19 nt, Artificial Sequence
  Synthetic
ccauuccauuguuugugca

SEQ ID NO: 72 - RNA, 19 nt, Artificial Sequence
  Synthetic
caggaccucauggaugggc

SEQ ID NO: 73 - RNA, 19 nt, Artificial Sequence
  Synthetic
gugaacuugcucaggacaa

SEQ ID NO: 74 - RNA, 19 nt, Artificial Sequence
  Synthetic
ccaggaccucauggauggg

SEQ ID NO: 75 - RNA, 19 nt, Artificial Sequence
  Synthetic
ggcugaaccaucacagaug

SEQ ID NO: 76 - RNA, 19 nt, Artificial Sequence
  Synthetic
ggugcugacuauccaguug

SEQ ID NO: 77 - RNA, 19 nt, Artificial Sequence
  Synthetic
auggcuuggaaugagacug

SEQ ID NO: 78 - RNA, 19 nt, Artificial Sequence
  Synthetic
gggaagacaucacugagcc

SEQ ID NO: 79 - RNA, 19 nt, Artificial Sequence
  Synthetic
uggugacagggaagacauc

SEQ ID NO: 80 - RNA, 19 nt, Artificial Sequence
  Synthetic
ugcucaucccacuaauguc

SEQ ID NO: 81 - RNA, 19 nt, Artificial Sequence
  Synthetic
cuauccaguugaugggcug

SEQ ID NO: 82 - RNA, 19 nt, Artificial Sequence
  Synthetic
ggaccucauggaugggcug

SEQ ID NO: 83 - RNA, 19 nt, Artificial Sequence
  Synthetic
cccacuggccucugauaaa

SEQ ID NO: 84 - RNA, 19 nt, Artificial Sequence
  Synthetic
uccgaaugucugaggacaa

SEQ ID NO: 85 - RNA, 19 nt, Artificial Sequence
  Synthetic
uggcuuggaaugagacugc

SEQ ID NO: 86 - RNA, 19 nt, Artificial Sequence
  Synthetic
uucagaugauauaaaugug

SEQ ID NO: 87 - RNA, 19 nt, Artificial Sequence
  Synthetic
ccacaagauuacaagaaac

SEQ ID NO: 88 - RNA, 19 nt, Artificial Sequence
  Synthetic
cucacuugcaauaauuaua

SEQ ID NO: 89 - RNA, 19 nt, Artificial Sequence
  Synthetic
cacuugcaauaauuauaag

SEQ ID NO: 90 - RNA, 19 nt, Artificial Sequence
  Synthetic
guaccaugcagaauacaaa

SEQ ID NO: 91 - RNA, 19 nt, Artificial Sequence
  Synthetic
ucaacgucuuguucagaac

SEQ ID NO: 92 - RNA, 19 nt, Artificial Sequence
  Synthetic
aucccaucuacacaguuug

SEQ ID NO: 93 - RNA, 19 nt, Artificial Sequence
  Synthetic
uacucaagcugauuugaug

SEQ ID NO: 94 - RNA, 19 nt, Artificial Sequence
  Synthetic
accagguggugguuaauaa

SEQ ID NO: 95 - RNA, 19 nt, Artificial Sequence
  Synthetic
gcugcaacuaaacaggaag

SEQ ID NO: 96 - RNA, 19 nt, Artificial Sequence
  Synthetic
uggauugauucgaaaucuu

SEQ ID NO: 97 - RNA, 19 nt, Artificial Sequence
  Synthetic
cagaugauauaaauguggu

SEQ ID NO: 98 - RNA, 19 nt, Artificial Sequence
  Synthetic
auggugucugcuauuguac

SEQ ID NO: 99 - RNA, 19 nt, Artificial Sequence
  Synthetic
cacaagauuacaagaaacg

SEQ ID NO: 100 - RNA, 19 nt, Artificial Sequence
  Synthetic
caaaugauguagaaacagc

SEQ ID NO: 101 - RNA, 19 nt, Artificial Sequence
  Synthetic
gccacaagauuacaagaaa

SEQ ID NO: 102 - RNA, 19 nt, Artificial Sequence
  Synthetic
uacaaaugauguagaaaca

SEQ ID NO: 103 - RNA, 19 nt, Artificial Sequence
  Synthetic
ucgaaaucuugcccuuugu

SEQ ID NO: 104 - RNA, 19 nt, Artificial Sequence
  Synthetic
gauuaacuaucaagaugau

SEQ ID NO: 105 - RNA, 19 nt, Artificial Sequence
  Synthetic
ccaguggauucuguguugu

SEQ ID NO: 106 - RNA, 19 nt, Artificial Sequence
  Synthetic
aaaggcuacuguuggauug

SEQ ID NO: 107 - RNA, 19 nt, Artificial Sequence
  Synthetic
acaaguagcugauauugau

SEQ ID NO: 108 - RNA, 19 nt, Artificial Sequence
  Synthetic
gauggaacaugagaugggu

SEQ ID NO: 109 - RNA, 19 nt, Artificial Sequence
  Synthetic
ucaagaugaugcagaacuu

SEQ ID NO: 110 - RNA, 19 nt, Artificial Sequence
  Synthetic
caagcugauuugauggagu

SEQ ID NO: 111 - RNA, 19 nt, Artificial Sequence
  Synthetic
uggacucucaggaaucuuu

SEQ ID NO: 112 - RNA, 19 nt, Artificial Sequence
  Synthetic
uaaauaccauuccauuguu

SEQ ID NO: 113 - RNA, 19 nt, Artificial Sequence
  Synthetic
auuacaucaagaaggagcu

SEQ ID NO: 114 - RNA, 19 nt, Artificial Sequence
  Synthetic
ucaggaaucuuucagaugc

SEQ ID NO: 115 - RNA, 19 nt, Artificial Sequence
  Synthetic
ugauuaacuaucaagauga

SEQ ID NO: 116 - RNA, 19 nt, Artificial Sequence
  Synthetic
acuucacucuaggaaugaa

SEQ ID NO: 117 - RNA, 19 nt, Artificial Sequence
  Synthetic
aacaugcaguuguaaacuu

SEQ ID NO: 118 - RNA, 19 nt, Artificial Sequence
  Synthetic
aagcugauuugauggaguu

SEQ ID NO: 119 - RNA, 19 nt, Artificial Sequence
  Synthetic
ucuggguucagaugauaua

SEQ ID NO: 120 - RNA, 19 nt, Artificial Sequence
  Synthetic
uuacuucacucuaggaaug

SEQ ID NO: 121 - RNA, 19 nt, Artificial Sequence
  Synthetic
aggaaucuuucagaugcug

SEQ ID NO: 122 - RNA, 19 nt, Artificial Sequence
  Synthetic
gcugaaacaugcaguugua

SEQ ID NO: 123 - RNA, 19 nt, Artificial Sequence
  Synthetic
guugcuuguucgugcacau

SEQ ID NO: 124 - RNA, 19 nt, Artificial Sequence
  Synthetic
ggaagaaauaguugaaggu

SEQ ID NO: 125 - RNA, 19 nt, Artificial Sequence
  Synthetic
aggacaagccacaagauua

SEQ ID NO: 126 - RNA, 19 nt, Artificial Sequence
  Synthetic
caugcguucuccucagaug

SEQ ID NO: 127 - RNA, 19 nt, Artificial Sequence
  Synthetic
gaugaucccagcuaccguu

SEQ ID NO: 128 - RNA, 19 nt, Artificial Sequence
  Synthetic
agccugccaucugugcucu

SEQ ID NO: 129 - RNA, 19 nt, Artificial Sequence
  Synthetic
uggauaucgccaggaugau

SEQ ID NO: 130 - RNA, 19 nt, Artificial Sequence
  Synthetic
ucuucgucaucugaccagc

SEQ ID NO: 131 - RNA, 19 nt, Artificial Sequence
  Synthetic
ugugaacuugcucaggaca

SEQ ID NO: 132 - RNA, 19 nt, Artificial Sequence
  Synthetic
ccugugcagcuggaauucu

SEQ ID NO: 133 - RNA, 19 nt, Artificial Sequence
  Synthetic
ugaacuugcucaggacaag

SEQ ID NO: 134 - RNA, 19 nt, Artificial Sequence
  Synthetic
ugcugacuauccaguugau

SEQ ID NO: 135 - RNA, 19 nt, Artificial Sequence
  Synthetic
gaugauauaaaugugguca

SEQ ID NO: 136 - RNA, 19 nt, Artificial Sequence
  Synthetic
gugcugacuauccaguuga

SEQ ID NO: 137 - RNA, 19 nt, Artificial Sequence
  Synthetic
ugacuauccaguugauggg

SEQ ID NO: 138 - RNA, 19 nt, Artificial Sequence
  Synthetic
aacuugcucaggacaagga

SEQ ID NO: 139 - RNA, 19 nt, Artificial Sequence
  Synthetic
cugacuauccaguugaugg

SEQ ID NO: 140 - RNA, 19 nt, Artificial Sequence
  Synthetic
gcucaucccacuaaugucc

SEQ ID NO: 141 - RNA, 19 nt, Artificial Sequence
  Synthetic
gcugacuauccaguugaug

SEQ ID NO: 142 - RNA, 19 nt, Artificial Sequence
  Synthetic
augauauaaauguggucac

SEQ ID NO: 143 - RNA, 19 nt, Artificial Sequence
  Synthetic
cucaucccacuaaugucca

SEQ ID NO: 144 - RNA, 19 nt, Artificial Sequence
  Synthetic
gcuuuauucucccauugaa

SEQ ID NO: 145 - RNA, 19 nt, Artificial Sequence
  Synthetic
cuggugcugacuauccagu

SEQ ID NO: 146 - RNA, 19 nt, Artificial Sequence
  Synthetic
aacugucuuuggacucuca

SEQ ID NO: 147 - RNA, 19 nt, Artificial Sequence
  Synthetic
agggcaugcagaucccauc

SEQ ID NO: 148 - RNA, 19 nt, Artificial Sequence
  Synthetic
gauauaaauguggucaccu

SEQ ID NO: 149 - RNA, 19 nt, Artificial Sequence
  Synthetic
uucagaugcugcaacuaaa

SEQ ID NO: 150 - RNA, 19 nt, Artificial Sequence
  Synthetic
aagaaauaguugaagguug

SEQ ID NO: 151 - RNA, 19 nt, Artificial Sequence
  Synthetic
ccaggaugauccuagcuau

SEQ ID NO: 152 - RNA, 19 nt, Artificial Sequence
  Synthetic
uggccaucuuuaagucugg

SEQ ID NO: 153 - RNA, 19 nt, Artificial Sequence
  Synthetic
agcugauauugauggacag

SEQ ID NO: 154 - RNA, 19 nt, Artificial Sequence
  Synthetic
ucgggauguucacaaccga

SEQ ID NO: 155 - RNA, 19 nt, Artificial Sequence
  Synthetic
uguagaagcugguggaaug

SEQ ID NO: 156 - RNA, 19 nt, Artificial Sequence
  Synthetic
uaaauauaaugaggaccua

SEQ ID NO: 157 - RNA, 19 nt, Artificial Sequence
  Synthetic
cugagacauuagaugaggg

SEQ ID NO: 158 - RNA, 19 nt, Artificial Sequence
  Synthetic
aguaaauauaaugaggacc

SEQ ID NO: 159 - RNA, 19 nt, Artificial Sequence
  Synthetic
uggauaccucccaaguccu

SEQ ID NO: 160 - RNA, 19 nt, Artificial Sequence
  Synthetic
aggaugccuuggguaugga

SEQ ID NO: 161 - RNA, 19 nt, Artificial Sequence
  Synthetic
auuguacguaccaugcaga

SEQ ID NO: 162 - RNA, 19 nt, Artificial Sequence
  Synthetic
uuuggacucucaggaaucu

SEQ ID NO: 163 - RNA, 19 nt, Artificial Sequence
  Synthetic
uuggauugauucgaaaucu

SEQ ID NO: 164 - RNA, 19 nt, Artificial Sequence
  Synthetic
ucagaggacuaaauaccau

SEQ ID NO: 165 - RNA, 19 nt, Artificial Sequence
  Synthetic
ccaggaugccuuggguaug

SEQ ID NO: 166 - RNA, 19 nt, Artificial Sequence
  Synthetic
auggaacaugagaugggug

SEQ ID NO: 167 - RNA, 19 nt, Artificial Sequence
  Synthetic
ggcuacuguuggauugauu

SEQ ID NO: 168 - RNA, 19 nt, Artificial Sequence
  Synthetic
aggaccucauggaugggcu

SEQ ID NO: 169 - RNA, 19 nt, Artificial Sequence
  Synthetic
ucugugcucuucgucaucu

SEQ ID NO: 170 - RNA, 19 nt, Artificial Sequence
  Synthetic
ugauggaguuggacauggc

SEQ ID NO: 171 - RNA, 19 nt, Artificial Sequence
  Synthetic
augagggcaugcagauccc

SEQ ID NO: 172 - RNA, 19 nt, Artificial Sequence
  Synthetic
acuauccaguugaugggcu

SEQ ID NO: 173 - RNA, 19 nt, Artificial Sequence
  Synthetic
ugagggcaugcagauccca

SEQ ID NO: 174 - RNA, 19 nt, Artificial Sequence
  Synthetic
uuggauaucgccaggauga

SEQ ID NO: 175 - RNA, 19 nt, Artificial Sequence
  Synthetic
gcccaggaccucauggaug

SEQ ID NO: 176 - RNA, 19 nt, Artificial Sequence
  Synthetic
aacuugccacacgugcaau

SEQ ID NO: 177 - RNA, 19 nt, Artificial Sequence
  Synthetic
cccaaguccuguaugagug

SEQ ID NO: 178 - RNA, 19 nt, Artificial Sequence
  Synthetic
cacagaugcugaaacaugc

SEQ ID NO: 179 - RNA, 19 nt, Artificial Sequence
  Synthetic
cugggaccuugcauaaccu

SEQ ID NO: 180 - RNA, 19 nt, Artificial Sequence
  Synthetic
aguggauucuguguuguuu

SEQ ID NO: 181 - RNA, 19 nt, Artificial Sequence
  Synthetic
aaugcaagcuuuaggacuu

SEQ ID NO: 182 - RNA, 19 nt, Artificial Sequence
  Synthetic
agaaauaguugaagguugu

SEQ ID NO: 183 - RNA, 19 nt, Artificial Sequence
  Synthetic
uccgcauggaagaaauagu

SEQ ID NO: 184 - RNA, 19 nt, Artificial Sequence
  Synthetic
gcuauguucccugagacau

SEQ ID NO: 185 - RNA, 19 nt, Artificial Sequence
  Synthetic
ucugagugguaaaggcaau

SEQ ID NO: 186 - RNA, 19 nt, Artificial Sequence
  Synthetic
ugcaagcuuuaggacuuca

SEQ ID NO: 187 - RNA, 19 nt, Artificial Sequence
  Synthetic
uggacaguaugcaaugacu

SEQ ID NO: 188 - RNA, 19 nt, Artificial Sequence
  Synthetic
uuaguaaauauaaugagga

SEQ ID NO: 189 - RNA, 19 nt, Artificial Sequence
  Synthetic
cucagauggugucugcuau

SEQ ID NO: 190 - RNA, 19 nt, Artificial Sequence
  Synthetic
agaacaaguagcugauauu

SEQ ID NO: 191 - RNA, 19 nt, Artificial Sequence
  Synthetic
cuuggauaucgccaggaug

SEQ ID NO: 192 - RNA, 19 nt, Artificial Sequence
  Synthetic
caucugugcucuucgucau

SEQ ID NO: 193 - RNA, 19 nt, Artificial Sequence
  Synthetic
cccuggugcugacuaucca

SEQ ID NO: 194 - RNA, 19 nt, Artificial Sequence
  Synthetic
acgacuaguucaguugcuu

SEQ ID NO: 195 - RNA, 19 nt, Artificial Sequence
  Synthetic
ucuuggacuugauauuggu

SEQ ID NO: 196 - RNA, 19 nt, Artificial Sequence
  Synthetic
ggaugauccuagcuaucgu

SEQ ID NO: 197 - RNA, 19 nt, Artificial Sequence
  Synthetic
aauacaaaugauguagaaa

SEQ ID NO: 198 - RNA, 19 nt, Artificial Sequence
  Synthetic
gaaccaucacagaugcuga

SEQ ID NO: 199 - RNA, 19 nt, Artificial Sequence
  Synthetic
uucacauccuagcucggga

SEQ ID NO: 200 - RNA, 19 nt, Artificial Sequence
  Synthetic
ugcagaucccaucuacaca

SEQ ID NO: 201 - RNA, 19 nt, Artificial Sequence
  Synthetic
ggacuaaauaccauuccau

SEQ ID NO: 202 - RNA, 19 nt, Artificial Sequence
  Synthetic
cugcuauuguacguaccau

SEQ ID NO: 203 - RNA, 19 nt, Artificial Sequence
  Synthetic
cagaggacuaaauaccauu

SEQ ID NO: 204 - RNA, 19 nt, Artificial Sequence
  Synthetic
gauaaaggcuacuguugga

SEQ ID NO: 205 - RNA, 19 nt, Artificial Sequence
  Synthetic
agaugauauaaaugugguc

SEQ ID NO: 206 - RNA, 19 nt, Artificial Sequence
  Synthetic
aaaucaugcaccuuugcgu

SEQ ID NO: 207 - RNA, 19 nt, Artificial Sequence
  Synthetic
acgacagacugccuucaaa

SEQ ID NO: 208 - RNA, 19 nt, Artificial Sequence
  Synthetic
uaguaaauauaaugaggac

SEQ ID NO: 209 - RNA, 19 nt, Artificial Sequence
  Synthetic
uaaugaggaccuauacuua

SEQ ID NO: 210 - RNA, 19 nt, Artificial Sequence
  Synthetic
ugcugaaacaugcaguugu

SEQ ID NO: 211 - RNA, 19 nt, Artificial Sequence
  Synthetic
auuugauggaguuggacau

SEQ ID NO: 212 - RNA, 19 nt, Artificial Sequence
  Synthetic
cugccaagugggugguaua

SEQ ID NO: 213 - RNA, 19 nt, Artificial Sequence
  Synthetic
uggacuaccaguugugguu

SEQ ID NO: 214 - RNA, 19 nt, Artificial Sequence
  Synthetic
uuaauaaggcugcaguuau

SEQ ID NO: 215 - RNA, 19 nt, Artificial Sequence
  Synthetic
acaucaagaaggagcuaaa

SEQ ID NO: 216 - RNA, 19 nt, Artificial Sequence
  Synthetic
ggauaucgccaggaugauc

SEQ ID NO: 217 - RNA, 19 nt, Artificial Sequence
  Synthetic
cugacagaguuacuucacu

SEQ ID NO: 218 - RNA, 19 nt, Artificial Sequence
  Synthetic
gugacagggaagacaucac

SEQ ID NO: 219 - RNA, 19 nt, Artificial Sequence
  Synthetic
ucaucccacuaauguccag

SEQ ID NO: 220 - RNA, 19 nt, Artificial Sequence
  Synthetic
cugccaucugugcucuucg

SEQ ID NO: 221 - RNA, 19 nt, Artificial Sequence
  Synthetic
auauaaauguggucaccug

SEQ ID NO: 222 - RNA, 19 nt, Artificial Sequence
  Synthetic
ccacccuggugcugacuau

SEQ ID NO: 223 - RNA, 19 nt, Artificial Sequence
  Synthetic
ugcucuucgucaucugacc

SEQ ID NO: 224 - RNA, 19 nt, Artificial Sequence
  Synthetic
acagggaagacaucacuga

SEQ ID NO: 225 - RNA, 19 nt, Artificial Sequence
  Synthetic
aguuggacauggccaugga

SEQ ID NO: 226 - RNA, 19 nt, Artificial Sequence
  Synthetic
uuggcugaaccaucacaga

SEQ ID NO: 227 - RNA, 19 nt, Artificial Sequence
  Synthetic
uagaugagggcaugcagau

SEQ ID NO: 228 - RNA, 19 nt, Artificial Sequence
  Synthetic
agaugagggcaugcagauc

SEQ ID NO: 229 - RNA, 19 nt, Artificial Sequence
  Synthetic
aucugugcucuucgucauc

SEQ ID NO: 230 - RNA, 19 nt, Artificial Sequence
  Synthetic
gaacuugccacacgugcaa

SEQ ID NO: 231 - RNA, 19 nt, Artificial Sequence
  Synthetic
ccaucugugcucuucguca

SEQ ID NO: 232 - RNA, 19 nt, Artificial Sequence
  Synthetic
auggcaaccaagaaagcaa

SEQ ID NO: 233 - RNA, 19 nt, Artificial Sequence
  Synthetic
gaaacaugcaguuguaaac

SEQ ID NO: 234 - RNA, 19 nt, Artificial Sequence
  Synthetic
ugguuaagcucuuacaccc

SEQ ID NO: 235 - RNA, 19 nt, Artificial Sequence
  Synthetic
agcuuuaguaaauauaaug

SEQ ID NO: 236 - RNA, 19 nt, Artificial Sequence
  Synthetic
cuaucaagaugaugcagaa

SEQ ID NO: 237 - RNA, 19 nt, Artificial Sequence
  Synthetic
aagucaacgucuuguucag

SEQ ID NO: 238 - RNA, 19 nt, Artificial Sequence
  Synthetic
gauccaagucaacgucuug

SEQ ID NO: 239 - RNA, 19 nt, Artificial Sequence
  Synthetic
cuaucaugcguucuccuca

SEQ ID NO: 240 - RNA, 19 nt, Artificial Sequence
  Synthetic
aauauaaugaggaccuaua

SEQ ID NO: 241 - RNA, 19 nt, Artificial Sequence
  Synthetic
gugcuaucugucugcucua

SEQ ID NO: 242 - RNA, 19 nt, Artificial Sequence
  Synthetic
gaagcuuccagacacgcua

SEQ ID NO: 243 - RNA, 19 nt, Artificial Sequence
  Synthetic
uaauuauaagaacaagaug

SEQ ID NO: 244 - RNA, 19 nt, Artificial Sequence
  Synthetic
auacaaaugauguagaaac

SEQ ID NO: 245 - RNA, 19 nt, Artificial Sequence
  Synthetic
cugucugcucuaguaauaa

SEQ ID NO: 246 - RNA, 19 nt, Artificial Sequence
  Synthetic
ugcuauuguacguaccaug

SEQ ID NO: 247 - RNA, 19 nt, Artificial Sequence
  Synthetic
ugcugaaggugcuaucugu

SEQ ID NO: 248 - RNA, 19 nt, Artificial Sequence
  Synthetic
ucuuuaagucuggaggcau

SEQ ID NO: 249 - RNA, 19 nt, Artificial Sequence
  Synthetic
auaccauuccauuguuugu

SEQ ID NO: 250 - RNA, 19 nt, Artificial Sequence
  Synthetic
aggcuacuguuggauugau

SEQ ID NO: 251 - RNA, 19 nt, Artificial Sequence
  Synthetic
caguuaugguccaucagcu

SEQ ID NO: 252 - RNA, 19 nt, Artificial Sequence
  Synthetic
acaagaugauggucugcca

SEQ ID NO: 253 - RNA, 19 nt, Artificial Sequence
  Synthetic
gacauaugcagcugcuguu

SEQ ID NO: 254 - RNA, 19 nt, Artificial Sequence
  Synthetic
ccaucaucgugagggcuua

SEQ ID NO: 255 - RNA, 19 nt, Artificial Sequence
  Synthetic
gacagauccaagucaacgu

SEQ ID NO: 256 - RNA, 19 nt, Artificial Sequence
  Synthetic
gagacauuagaugagggca

SEQ ID NO: 257 - RNA, 19 nt, Artificial Sequence
  Synthetic
uucgccuucacuauggacu

SEQ ID NO: 258 - RNA, 19 nt, Artificial Sequence
  Synthetic
uguucagcuucuggguuca

SEQ ID NO: 259 - RNA, 19 nt, Artificial Sequence
  Synthetic
aucuuggacuugauauugg

SEQ ID NO: 260 - RNA, 19 nt, Artificial Sequence
  Synthetic
cgugcaaucccugaacuga

SEQ ID NO: 261 - RNA, 19 nt, Artificial Sequence
  Synthetic
agguggugguuaauaaggc

SEQ ID NO: 262 - RNA, 19 nt, Artificial Sequence
  Synthetic
ucuacacaguuugaugcug

SEQ ID NO: 263 - RNA, 19 nt, Artificial Sequence
  Synthetic
agauggcccagaaugcagu

SEQ ID NO: 264 - RNA, 19 nt, Artificial Sequence
  Synthetic
caagauuacaagaaacggc

SEQ ID NO: 265 - RNA, 19 nt, Artificial Sequence
  Synthetic
cugaaacaugcaguuguaa

SEQ ID NO: 266 - RNA, 19 nt, Artificial Sequence
  Synthetic
cuccuucucugagugguaa

SEQ ID NO: 267 - RNA, 19 nt, Artificial Sequence
  Synthetic
agcaagcucaucauacugg

SEQ ID NO: 268 - RNA, 19 nt, Artificial Sequence
  Synthetic
auuauaagaacaagaugau

SEQ ID NO: 269 - RNA, 19 nt, Artificial Sequence
  Synthetic
ucugucugcucuaguaaua

SEQ ID NO: 270 - RNA, 19 nt, Artificial Sequence
  Synthetic
aagcuuuaguaaauauaau

SEQ ID NO: 271 - RNA, 19 nt, Artificial Sequence
  Synthetic
gccggcuauuguagaagcu

SEQ ID NO: 272 - RNA, 19 nt, Artificial Sequence
  Synthetic
ugucugcucuaguaauaag

SEQ ID NO: 273 - RNA, 19 nt, Artificial Sequence
  Synthetic
aauaauuauaagaacaaga

SEQ ID NO: 274 - RNA, 19 nt, Artificial Sequence
  Synthetic
uauggccaggaugccuugg

SEQ ID NO: 275 - RNA, 19 nt, Artificial Sequence
  Synthetic
ugucccgcaaaucaugcac

SEQ ID NO: 276 - RNA, 19 nt, Artificial Sequence
  Synthetic
cuuguucagaacugucuuu

SEQ ID NO: 277 - RNA, 19 nt, Artificial Sequence
  Synthetic
gcugugauacgaugcuuca

SEQ ID NO: 278 - RNA, 19 nt, Artificial Sequence
  Synthetic
gcgccguacguccaugggu

SEQ ID NO: 279 - RNA, 19 nt, Artificial Sequence
  Synthetic
agauggugucugcuauugu

SEQ ID NO: 280 - RNA, 19 nt, Artificial Sequence
  Synthetic
agaacugucuuuggacucu

SEQ ID NO: 281 - RNA, 19 nt, Artificial Sequence
  Synthetic
caugcagaucccaucuaca

SEQ ID NO: 282 - RNA, 19 nt, Artificial Sequence
  Synthetic
cuccuugggacucuuguuc

SEQ ID NO: 283 - RNA, 19 nt, Artificial Sequence
  Synthetic
ggugccacuaccacagcuc

SEQ ID NO: 284 - RNA, 19 nt, Artificial Sequence
  Synthetic
agcugguggaaugcaagcu

SEQ ID NO: 285 - RNA, 19 nt, Artificial Sequence
  Synthetic
ccauuccacgacuaguuca

SEQ ID NO: 286 - RNA, 19 nt, Artificial Sequence
  Synthetic
cagcguuuggcugaaccau

SEQ ID NO: 287 - RNA, 19 nt, Artificial Sequence
  Synthetic
aucuuuaagucuggaggca

SEQ ID NO: 288 - RNA, 19 nt, Artificial Sequence
  Synthetic
uggccaggaugccuugggu

SEQ ID NO: 289 - RNA, 19 nt, Artificial Sequence
  Synthetic
gaauacaaaugauguagaa

SEQ ID NO: 290 - RNA, 19 nt, Artificial Sequence
  Synthetic
uggaugggcugccuccagg

SEQ ID NO: 291 - RNA, 19 nt, Artificial Sequence
  Synthetic
cguacguccauggguggga

SEQ ID NO: 292 - RNA, 19 nt, Artificial Sequence
  Synthetic
ggugucugcuauuguacgu

SEQ ID NO: 293 - RNA, 19 nt, Artificial Sequence
  Synthetic
ggugcuaucugucugcucu

SEQ ID NO: 294 - RNA, 19 nt, Artificial Sequence
  Synthetic
ccuucacuauggacuacca

SEQ ID NO: 295 - RNA, 19 nt, Artificial Sequence
  Synthetic
gacucuuguucagcuucug

SEQ ID NO: 296 - RNA, 19 nt, Artificial Sequence
  Synthetic
aucuacacaguuugaugcu

SEQ ID NO: 297 - RNA, 19 nt, Artificial Sequence
  Synthetic
guuugugcagcugcuuuau

SEQ ID NO: 298 - RNA, 19 nt, Artificial Sequence
  Synthetic
caagaaacggcuuucaguu

SEQ ID NO: 299 - RNA, 19 nt, Artificial Sequence
  Synthetic
guucaguugcuuguucgug

SEQ ID NO: 300 - RNA, 19 nt, Artificial Sequence
  Synthetic
ucagaugauauaaaugugg

SEQ ID NO: 301 - RNA, 19 nt, Artificial Sequence
  Synthetic
aauguuaaauucuuggcua

SEQ ID NO: 302 - RNA, 19 nt, Artificial Sequence
  Synthetic
uggguucagaugauauaaa

SEQ ID NO: 303 - RNA, 19 nt, Artificial Sequence
  Synthetic
aauaguugaagguuguacc

SEQ ID NO: 304 - RNA, 19 nt, Artificial Sequence
  Synthetic
caugcaguuguaaacuuga

SEQ ID NO: 305 - RNA, 19 nt, Artificial Sequence
  Synthetic
aaucugaauaaaguguaac

SEQ ID NO: 306 - RNA, 19 nt, Artificial Sequence
  Synthetic
caccacccuggugcugacu

SEQ ID NO: 307 - RNA, 19 nt, Artificial Sequence
  Synthetic
gaguuggacauggccaugg

SEQ ID NO: 308 - RNA, 19 nt, Artificial Sequence
  Synthetic
auacccagcgccguacguc

SEQ ID NO: 309 - RNA, 19 nt, Artificial Sequence
  Synthetic
gagggcuuacuggccaucu

SEQ ID NO: 310 - RNA, 19 nt, Artificial Sequence
  Synthetic
gagggcaugcagaucccau

SEQ ID NO: 311 - RNA, 19 nt, Artificial Sequence
  Synthetic
gaagggauggaaggucucc

SEQ ID NO: 312 - RNA, 19 nt, Artificial Sequence
  Synthetic
gucugaggacaagccacaa

SEQ ID NO: 313 - RNA, 19 nt, Artificial Sequence
  Synthetic
ucaugcaccuuugcgugag

SEQ ID NO: 314 - RNA, 19 nt, Artificial Sequence
  Synthetic
ggaaucuuucagaugcugc

SEQ ID NO: 315 - RNA, 19 nt, Artificial Sequence
  Synthetic
ucaccugacagauccaagu

SEQ ID NO: 316 - RNA, 19 nt, Artificial Sequence
  Synthetic
cugaaggugcuaucugucu

SEQ ID NO: 317 - RNA, 19 nt, Artificial Sequence
  Synthetic
gucaucugaccagccgaca

SEQ ID NO: 318 - RNA, 19 nt, Artificial Sequence
  Synthetic
cauuccacgacuaguucag

SEQ ID NO: 319 - RNA, 19 nt, Artificial Sequence
  Synthetic
ugauccuagcuaucguucu

SEQ ID NO: 320 - RNA, 19 nt, Artificial Sequence
  Synthetic
gagcccuucacauccuagc

SEQ ID NO: 321 - RNA, 19 nt, Artificial Sequence
  Synthetic
gaugagggcaugcagaucc

SEQ ID NO: 322 - RNA, 19 nt, Artificial Sequence
  Synthetic
auggguaggguaaaucagu

SEQ ID NO: 323 - RNA, 19 nt, Artificial Sequence
  Synthetic
gugcaaucccugaacugac

SEQ ID NO: 324 - RNA, 19 nt, Artificial Sequence
  Synthetic
auuccauuguuugugcagc

SEQ ID NO: 325 - RNA, 19 nt, Artificial Sequence
  Synthetic
cauucuggugccacuacca

SEQ ID NO: 326 - RNA, 19 nt, Artificial Sequence
  Synthetic
uaccaugcagaauacaaau

SEQ ID NO: 327 - RNA, 19 nt, Artificial Sequence
  Synthetic
augcaguucgccuucacua

SEQ ID NO: 328 - RNA, 19 nt, Artificial Sequence
  Synthetic
uuacuggccaucuuuaagu

SEQ ID NO: 329 - RNA, 19 nt, Artificial Sequence
  Synthetic
gcuucuggguucagaugau

SEQ ID NO: 330 - RNA, 19 nt, Artificial Sequence
  Synthetic
caggaagggauggaagguc

SEQ ID NO: 331 - RNA, 19 nt, Artificial Sequence
  Synthetic
gcuuauggcaaccaagaaa

SEQ ID NO: 332 - RNA, 19 nt, Artificial Sequence
  Synthetic
ugacagggaagacaucacu

SEQ ID NO: 333 - RNA, 19 nt, Artificial Sequence
  Synthetic
aucgccaggaugauccuag

SEQ ID NO: 334 - RNA, 19 nt, Artificial Sequence
  Synthetic
aguaauaagccggcuauug

SEQ ID NO: 335 - RNA, 19 nt, Artificial Sequence
  Synthetic
aaugauguagaaacagcuc

SEQ ID NO: 336 - RNA, 19 nt, Artificial Sequence
  Synthetic
ucugaggacaagccacaag

SEQ ID NO: 337 - RNA, 19 nt, Artificial Sequence
  Synthetic
ggucuccuugggacucuug

SEQ ID NO: 338 - RNA, 19 nt, Artificial Sequence
  Synthetic
uguucagaacugucuuugg

SEQ ID NO: 339 - RNA, 19 nt, Artificial Sequence
  Synthetic
cuggugccacuaccacagc

SEQ ID NO: 340 - RNA, 19 nt, Artificial Sequence
  Synthetic
guccaugggugggacacag

SEQ ID NO: 341 - RNA, 19 nt, Artificial Sequence
  Synthetic
gugcguuuagcuggugggc

SEQ ID NO: 342 - RNA, 19 nt, Artificial Sequence
  Synthetic
acguaccaugcagaauaca

SEQ ID NO: 343 - RNA, 19 nt, Artificial Sequence
  Synthetic
gauguucacaaccgaauug

SEQ ID NO: 344 - RNA, 19 nt, Artificial Sequence
  Synthetic
agaaagcaagcucaucaua

SEQ ID NO: 345 - RNA, 19 nt, Artificial Sequence
  Synthetic
guucagcuucuggguucag

SEQ ID NO: 346 - RNA, 19 nt, Artificial Sequence
  Synthetic
gcagggugccauuccacga

SEQ ID NO: 347 - RNA, 19 nt, Artificial Sequence
  Synthetic
uagaagcugguggaaugca

SEQ ID NO: 348 - RNA, 19 nt, Artificial Sequence
  Synthetic
cauggaagaaauaguugaa

SEQ ID NO: 349 - RNA, 19 nt, Artificial Sequence
  Synthetic
ugauauuggugcccaggga

SEQ ID NO: 350 - RNA, 19 nt, Artificial Sequence
  Synthetic
ggcaugcagaucccaucua

SEQ ID NO: 351 - RNA, 19 nt, Artificial Sequence
  Synthetic
cguacuguccuucgggcug

SEQ ID NO: 352 - RNA, 19 nt, Artificial Sequence
  Synthetic
uuacgacagacugccuuca

SEQ ID NO: 353 - RNA, 19 nt, Artificial Sequence
  Synthetic
uagucacuggcagcaacag

SEQ ID NO: 354 - RNA, 19 nt, Artificial Sequence
  Synthetic
gccauuacaacucuccaca

SEQ ID NO: 355 - RNA, 19 nt, Artificial Sequence
  Synthetic
gccuucacuauggacuacc

SEQ ID NO: 356 - RNA, 19 nt, Artificial Sequence
  Synthetic
guucacaaccgaauuguua

SEQ ID NO: 357 - RNA, 19 nt, Artificial Sequence
  Synthetic
gggaccuugcauaaccuuu

SEQ ID NO: 358 - RNA, 19 nt, Artificial Sequence
  Synthetic
aagccacaagauuacaaga

SEQ ID NO: 359 - RNA, 19 nt, Artificial Sequence
  Synthetic
gcagcaacagucuuaccug

SEQ ID NO: 360 - RNA, 19 nt, Artificial Sequence
  Synthetic
uauuacaucaagaaggagc

SEQ ID NO: 361 - RNA, 19 nt, Artificial Sequence
  Synthetic
uaauaaggcugcaguuaug

SEQ ID NO: 362 - RNA, 19 nt, Artificial Sequence
  Synthetic
gguggugguuaauaaggcu

SEQ ID NO: 363 - RNA, 19 nt, Artificial Sequence
  Synthetic
uaauguccagcguuuggcu

SEQ ID NO: 364 - RNA, 19 nt, Artificial Sequence
  Synthetic
cuucucugagugguaaagg

SEQ ID NO: 365 - RNA, 19 nt, Artificial Sequence
  Synthetic
accagccgacaccaagaag

SEQ ID NO: 366 - RNA, 19 nt, Artificial Sequence
  Synthetic
auaccucccaaguccugua

SEQ ID NO: 367 - RNA, 19 nt, Artificial Sequence
  Synthetic
ucacuauggacuaccaguu

SEQ ID NO: 368 - RNA, 19 nt, Artificial Sequence
  Synthetic
aggauacccagcgccguac

SEQ ID NO: 369 - RNA, 19 nt, Artificial Sequence
  Synthetic
agggaagacaucacugagc

SEQ ID NO: 370 - RNA, 19 nt, Artificial Sequence
  Synthetic
gauaucgccaggaugaucc

SEQ ID NO: 371 - RNA, 19 nt, Artificial Sequence
  Synthetic
aaguagcugauauugaugg

SEQ ID NO: 372 - RNA, 19 nt, Artificial Sequence
  Synthetic
caagcuuuaggacuucacc

SEQ ID NO: 373 - RNA, 19 nt, Artificial Sequence
  Synthetic
cccuuugucccgcaaauca

SEQ ID NO: 374 - RNA, 19 nt, Artificial Sequence
  Synthetic
uuagaugagggcaugcaga

SEQ ID NO: 375 - RNA, 19 nt, Artificial Sequence
  Synthetic
caaugacucgagcucagag

SEQ ID NO: 376 - RNA, 19 nt, Artificial Sequence
  Synthetic
guggauauggccaggaugc

SEQ ID NO: 377 - RNA, 19 nt, Artificial Sequence
  Synthetic
guucagaugauauaaaugu

SEQ ID NO: 378 - RNA, 19 nt, Artificial Sequence
  Synthetic
ucaggacaaggaagcugca

SEQ ID NO: 379 - RNA, 19 nt, Artificial Sequence
  Synthetic
uugaagcugagggagccac

SEQ ID NO: 380 - RNA, 19 nt, Artificial Sequence
  Synthetic
uggaguuggacauggccau

SEQ ID NO: 381 - RNA, 19 nt, Artificial Sequence
  Synthetic
agaugcugaaacaugcagu

SEQ ID NO: 382 - RNA, 19 nt, Artificial Sequence
  Synthetic
ugauggucugccaaguggg

SEQ ID NO: 383 - RNA, 19 nt, Artificial Sequence
  Synthetic
acaugcaguuguaaacuug

SEQ ID NO: 384 - RNA, 19 nt, Artificial Sequence
  Synthetic
cagaguuacuucacucuag

SEQ ID NO: 385 - RNA, 19 nt, Artificial Sequence
  Synthetic
gacucgagcucagagggua

SEQ ID NO: 386 - RNA, 19 nt, Artificial Sequence
  Synthetic
cuggccaucuuuaagucug

SEQ ID NO: 387 - RNA, 19 nt, Artificial Sequence
  Synthetic
uacgaugcuucaagagaaa

SEQ ID NO: 388 - RNA, 19 nt, Artificial Sequence
  Synthetic
ugaccagcucucucuucag

SEQ ID NO: 389 - RNA, 19 nt, Artificial Sequence
  Synthetic
cucucuucagaacagagcc

SEQ ID NO: 390 - RNA, 19 nt, Artificial Sequence
  Synthetic
gcuuucaguugagcugacc

SEQ ID NO: 391 - RNA, 19 nt, Artificial Sequence
  Synthetic
gggugggacacagcagcaa

SEQ ID NO: 392 - RNA, 19 nt, Artificial Sequence
  Synthetic
ugccacacgugcaaucccu

SEQ ID NO: 393 - RNA, 19 nt, Artificial Sequence
  Synthetic
ucugugaacuugcucagga

SEQ ID NO: 394 - RNA, 19 nt, Artificial Sequence
  Synthetic
ugaguaaugguguagaaca

SEQ ID NO: 395 - RNA, 19 nt, Artificial Sequence
  Synthetic
guuggauugauucgaaauc

SEQ ID NO: 396 - RNA, 19 nt, Artificial Sequence
  Synthetic
uacaacucuccacaaccuu

SEQ ID NO: 397 - RNA, 19 nt, Artificial Sequence
  Synthetic
caaguccuguaugaguggg

SEQ ID NO: 398 - RNA, 19 nt, Artificial Sequence
  Synthetic
aggaagggauggaaggucu

SEQ ID NO: 399 - RNA, 19 nt, Artificial Sequence
  Synthetic
agcucaucauacuggcuag

SEQ ID NO: 400 - RNA, 19 nt, Artificial Sequence
  Synthetic
gcaagcuuuaggacuucac

SEQ ID NO: 401 - RNA, 19 nt, Artificial Sequence
  Synthetic
auguggucaccugugcagc

SEQ ID NO: 402 - RNA, 19 nt, Artificial Sequence
  Synthetic
acucaagcugauuugaugg

SEQ ID NO: 403 - RNA, 19 nt, Artificial Sequence
  Synthetic
gacauggccauggaaccag

SEQ ID NO: 404 - RNA, 19 nt, Artificial Sequence
  Synthetic
guaaauauaaugaggaccu

SEQ ID NO: 405 - RNA, 19 nt, Artificial Sequence
  Synthetic
cgcauggaagaaauaguug

SEQ ID NO: 406 - RNA, 19 nt, Artificial Sequence
  Synthetic
gaugcugcaacuaaacagg

SEQ ID NO: 407 - RNA, 19 nt, Artificial Sequence
  Synthetic
ugauggaacaugagauggg

SEQ ID NO: 408 - RNA, 19 nt, Artificial Sequence
  Synthetic
ccagguggugguuaauaag

SEQ ID NO: 409 - RNA, 19 nt, Artificial Sequence
  Synthetic
ugaggacaagccacaagau

SEQ ID NO: 410 - RNA, 19 nt, Artificial Sequence
  Synthetic
acuggccaucuuuaagucu

SEQ ID NO: 411 - RNA, 19 nt, Artificial Sequence
  Synthetic
aacggcuuucaguugagcu

SEQ ID NO: 412 - RNA, 19 nt, Artificial Sequence
  Synthetic
cuacuguuggauugauucg

SEQ ID NO: 413 - RNA, 19 nt, Artificial Sequence
  Synthetic
guugugguuaagcucuuac

SEQ ID NO: 414 - RNA, 19 nt, Artificial Sequence
  Synthetic
auacuggcuagugguggac

SEQ ID NO: 415 - RNA, 19 nt, Artificial Sequence
  Synthetic
gaccucauggaugggcugc

SEQ ID NO: 416 - RNA, 19 nt, Artificial Sequence
  Synthetic
uagcucgggauguucacaa

SEQ ID NO: 417 - RNA, 19 nt, Artificial Sequence
  Synthetic
gaacaugagauggguggcc

SEQ ID NO: 418 - RNA, 19 nt, Artificial Sequence
  Synthetic
cagaaugcaguucgccuuc

SEQ ID NO: 419 - RNA, 19 nt, Artificial Sequence
  Synthetic
acguccaugggugggacac

SEQ ID NO: 420 - RNA, 19 nt, Artificial Sequence
  Synthetic
ugguucaccaguggauucu

SEQ ID NO: 421 - RNA, 19 nt, Artificial Sequence
  Synthetic
auaucgccaggaugauccu

SEQ ID NO: 422 - RNA, 19 nt, Artificial Sequence
  Synthetic
aacaggaagggauggaagg

SEQ ID NO: 423 - RNA, 19 nt, Artificial Sequence
  Synthetic
guugagcugaccagcucuc

SEQ ID NO: 424 - RNA, 19 nt, Artificial Sequence
  Synthetic
aaauguuaaauucuuggcu

SEQ ID NO: 425 - RNA, 19 nt, Artificial Sequence
  Synthetic
ggcuauuguagaagcuggu

SEQ ID NO: 426 - RNA, 19 nt, Artificial Sequence
  Synthetic
caguugugguuaagcucuu

SEQ ID NO: 427 - RNA, 19 nt, Artificial Sequence
  Synthetic
cuacacaguuugaugcugc

SEQ ID NO: 428 - RNA, 19 nt, Artificial Sequence
  Synthetic
uggaggcauuccugcccug

SEQ ID NO: 429 - RNA, 19 nt, Artificial Sequence
  Synthetic
ggacaguuuaccaguugcc

SEQ ID NO: 430 - RNA, 19 nt, Artificial Sequence
  Synthetic
uccauucuggugccacuac

SEQ ID NO: 431 - RNA, 19 nt, Artificial Sequence
  Synthetic
uacacccaccaucccacug

SEQ ID NO: 432 - RNA, 19 nt, Artificial Sequence
  Synthetic
cugagccugccaucugugc

SEQ ID NO: 433 - RNA, 19 nt, Artificial Sequence
  Synthetic
gaggcauuccugcccuggu

SEQ ID NO: 434 - RNA, 19 nt, Artificial Sequence
  Synthetic
cuuggcuauuacgacagac

SEQ ID NO: 435 - RNA, 19 nt, Artificial Sequence
  Synthetic
cccugagacauuagaugag

SEQ ID NO: 436 - RNA, 19 nt, Artificial Sequence
  Synthetic
augcaaugacucgagcuca

SEQ ID NO: 437 - RNA, 19 nt, Artificial Sequence
  Synthetic
uagaggcucuugugcguac

SEQ ID NO: 438 - RNA, 19 nt, Artificial Sequence
  Synthetic
uucacucuaggaaugaagg

SEQ ID NO: 439 - RNA, 19 nt, Artificial Sequence
  Synthetic
gacaagccacaagauuaca

SEQ ID NO: 440 - RNA, 19 nt, Artificial Sequence
  Synthetic
cagaacuugccacacgugc

SEQ ID NO: 441 - RNA, 19 nt, Artificial Sequence
  Synthetic
gaccuugcauaaccuuucc

SEQ ID NO: 442 - RNA, 19 nt, Artificial Sequence
  Synthetic
cacuaccacagcuccuucu

SEQ ID NO: 443 - RNA, 19 nt, Artificial Sequence
  Synthetic
cuauuugggauauguaugg

SEQ ID NO: 444 - RNA, 19 nt, Artificial Sequence
  Synthetic
ucuuguucagaacugucuu

SEQ ID NO: 445 - RNA, 19 nt, Artificial Sequence
  Synthetic
gaugccuuggguauggacc

SEQ ID NO: 446 - RNA, 19 nt, Artificial Sequence
  Synthetic
uuguagaagcugguggaau

SEQ ID NO: 447 - RNA, 19 nt, Artificial Sequence
  Synthetic
agguguggcgacauaugca

SEQ ID NO: 448 - RNA, 19 nt, Artificial Sequence
  Synthetic
gcaaucccugaacugacaa

SEQ ID NO: 449 - RNA, 19 nt, Artificial Sequence
  Synthetic
ugcucuaguaauaagccgg

SEQ ID NO: 450 - RNA, 19 nt, Artificial Sequence
  Synthetic
ccgacaccaagaagcagag

SEQ ID NO: 451 - RNA, 19 nt, Artificial Sequence
  Synthetic
agaugaugcagaacuugcc

SEQ ID NO: 452 - RNA, 19 nt, Artificial Sequence
  Synthetic
uugaugggcugccagaucu

SEQ ID NO: 453 - RNA, 19 nt, Artificial Sequence
  Synthetic
agccgacaccaagaagcag

SEQ ID NO: 454 - RNA, 19 nt, Artificial Sequence
  Synthetic
uauggguaggguaaaucag

SEQ ID NO: 455 - RNA, 19 nt, Artificial Sequence
  Synthetic
cucaucauacuggcuagug

SEQ ID NO: 456 - RNA, 19 nt, Artificial Sequence
  Synthetic
uauuacgacagacugccuu

SEQ ID NO: 457 - RNA, 19 nt, Artificial Sequence
  Synthetic
caaucccugaacugacaaa

SEQ ID NO: 458 - RNA, 19 nt, Artificial Sequence
  Synthetic
ucuccuugggacucuuguu

SEQ ID NO: 459 - RNA, 19 nt, Artificial Sequence
  Synthetic
gagauggguggccaccacc

SEQ ID NO: 460 - RNA, 19 nt, Artificial Sequence
  Synthetic
cagggugccauuccacgac

SEQ ID NO: 461 - RNA, 19 nt, Artificial Sequence
  Synthetic
aguuacuucacucuaggaa

SEQ ID NO: 462 - RNA, 19 nt, Artificial Sequence
  Synthetic
uuggacuugauauuggugc

SEQ ID NO: 463 - RNA, 19 nt, Artificial Sequence
  Synthetic
cccuucacauccuagcucg

SEQ ID NO: 464 - RNA, 19 nt, Artificial Sequence
  Synthetic
agacacgcuaucaugcguu

SEQ ID NO: 465 - RNA, 19 nt, Artificial Sequence
  Synthetic
aaugcaguucgccuucacu

SEQ ID NO: 466 - RNA, 19 nt, Artificial Sequence
  Synthetic
cuuauggcaaccaagaaag

SEQ ID NO: 467 - RNA, 19 nt, Artificial Sequence
  Synthetic
cucccaaguccuguaugag

SEQ ID NO: 468 - RNA, 19 nt, Artificial Sequence
  Synthetic
cuuacacccaccaucccac

SEQ ID NO: 469 - RNA, 19 nt, Artificial Sequence
  Synthetic
uggaaggucuccuugggac

SEQ ID NO: 470 - RNA, 19 nt, Artificial Sequence
  Synthetic
agcccuucacauccuagcu

SEQ ID NO: 471 - RNA, 19 nt, Artificial Sequence
  Synthetic
gaugggcugccuccaggug

SEQ ID NO: 472 - RNA, 19 nt, Artificial Sequence
  Synthetic
agcuucuggguucagauga

SEQ ID NO: 473 - RNA, 19 nt, Artificial Sequence
  Synthetic
gagccugccaucugugcuc

SEQ ID NO: 474 - RNA, 19 nt, Artificial Sequence
  Synthetic
uuaagucuggaggcauucc

SEQ ID NO: 475 - RNA, 19 nt, Artificial Sequence
  Synthetic
accugugcagcuggaauuc

SEQ ID NO: 476 - RNA, 19 nt, Artificial Sequence
  Synthetic
ucccgcaaaucaugcaccu

SEQ ID NO: 477 - RNA, 19 nt, Artificial Sequence
  Synthetic
aagguguggcgacauaugc

SEQ ID NO: 478 - RNA, 19 nt, Artificial Sequence
  Synthetic
agcuauugaagcugaggga

SEQ ID NO: 479 - RNA, 19 nt, Artificial Sequence
  Synthetic
guuagucacuggcagcaac

SEQ ID NO: 480 - RNA, 19 nt, Artificial Sequence
  Synthetic
uucaguugcuuguucgugc

SEQ ID NO: 481 - RNA, 19 nt, Artificial Sequence
  Synthetic
gaugauggucugccaagug

SEQ ID NO: 482 - RNA, 19 nt, Artificial Sequence
  Synthetic
cuaaacaggaagggaugga

SEQ ID NO: 483 - RNA, 19 nt, Artificial Sequence
  Synthetic
ccacgacuaguucaguugc

SEQ ID NO: 484 - RNA, 19 nt, Artificial Sequence
  Synthetic
acuaguucaguugcuuguu

SEQ ID NO: 485 - RNA, 19 nt, Artificial Sequence
  Synthetic
guucaccaguggauucugu

SEQ ID NO: 486 - RNA, 19 nt, Artificial Sequence
  Synthetic
gugguaaaggcaauccuga

SEQ ID NO: 487 - RNA, 19 nt, Artificial Sequence
  Synthetic
uugauggaguuggacaugg

SEQ ID NO: 488 - RNA, 19 nt, Artificial Sequence
  Synthetic
acuugcucaggacaaggaa

SEQ ID NO: 489 - RNA, 19 nt, Artificial Sequence
  Synthetic
ccaguugaugggcugccag

SEQ ID NO: 490 - RNA, 19 nt, Artificial Sequence
  Synthetic
gaaagcaagcucaucauac

SEQ ID NO: 491 - RNA, 19 nt, Artificial Sequence
  Synthetic
acauuagaugagggcaugc

SEQ ID NO: 492 - RNA, 19 nt, Artificial Sequence
  Synthetic
ucccacuaauguccagcgu

SEQ ID NO: 493 - RNA, 19 nt, Artificial Sequence
  Synthetic
ggcaaccaagaaagcaagc

SEQ ID NO: 494 - RNA, 19 nt, Artificial Sequence
  Synthetic
aaauaguugaagguuguac

SEQ ID NO: 495 - RNA, 19 nt, Artificial Sequence
  Synthetic
ggauauguauggguagggu

SEQ ID NO: 496 - RNA, 19 nt, Artificial Sequence
  Synthetic
uaaucugaauaaaguguaa

SEQ ID NO: 497 - RNA, 19 nt, Artificial Sequence
  Synthetic
ugcacaucaggauacccag

SEQ ID NO: 498 - RNA, 19 nt, Artificial Sequence
  Synthetic
guaauaagccggcuauugu

SEQ ID NO: 499 - RNA, 19 nt, Artificial Sequence
  Synthetic
aagcucaucauacuggcua

SEQ ID NO: 500 - RNA, 19 nt, Artificial Sequence
  Synthetic
acgugcaaucccugaacug

SEQ ID NO: 501 - RNA, 19 nt, Artificial Sequence
  Synthetic
aguugugguuaagcucuua

SEQ ID NO: 502 - RNA, 19 nt, Artificial Sequence
  Synthetic
aggaccagguggugguuaa

SEQ ID NO: 503 - RNA, 19 nt, Artificial Sequence
  Synthetic
gcucuaguaauaagccggc

SEQ ID NO: 504 - RNA, 19 nt, Artificial Sequence
  Synthetic
gauuugauggaguuggaca

SEQ ID NO: 505 - RNA, 19 nt, Artificial Sequence
  Synthetic
ugauguagaaacagcucgu

SEQ ID NO: 506 - RNA, 19 nt, Artificial Sequence
  Synthetic
cugguggauauggccagga

SEQ ID NO: 507 - RNA, 19 nt, Artificial Sequence
  Synthetic
caucauacuggcuaguggu

SEQ ID NO: 508 - RNA, 19 nt, Artificial Sequence
  Synthetic
gaucccaucuacacaguuu

SEQ ID NO: 509 - RNA, 19 nt, Artificial Sequence
  Synthetic
cacgcuaucaugcguucuc

SEQ ID NO: 510 - RNA, 19 nt, Artificial Sequence
  Synthetic
gacaguaugcaaugacucg

SEQ ID NO: 511 - RNA, 19 nt, Artificial Sequence
  Synthetic
aaguuguuguaaccugcug

SEQ ID NO: 512 - RNA, 19 nt, Artificial Sequence
  Synthetic
gcuauuacgacagacugcc

SEQ ID NO: 513 - RNA, 19 nt, Artificial Sequence
  Synthetic
gccuccaggugacagcaau

SEQ ID NO: 514 - RNA, 19 nt, Artificial Sequence
  Synthetic
uccuguaugagugggaaca

SEQ ID NO: 515 - RNA, 19 nt, Artificial Sequence
  Synthetic
augcagaucccaucuacac

SEQ ID NO: 516 - RNA, 19 nt, Artificial Sequence
  Synthetic
uuucccaucaucgugaggg

SEQ ID NO: 517 - RNA, 19 nt, Artificial Sequence
  Synthetic
ccaagugggugguauagag

SEQ ID NO: 518 - RNA, 19 nt, Artificial Sequence
  Synthetic
ggaccuugcauaaccuuuc

SEQ ID NO: 519 - RNA, 19 nt, Artificial Sequence
  Synthetic
ucccaaguccuguaugagu

SEQ ID NO: 520 - RNA, 19 nt, Artificial Sequence
  Synthetic
cacgacuaguucaguugcu

SEQ ID NO: 521 - RNA, 19 nt, Artificial Sequence
  Synthetic
ccgcauggaagaaauaguu

SEQ ID NO: 522 - RNA, 19 nt, Artificial Sequence
  Synthetic
ggcccagaaugcaguucgc

SEQ ID NO: 523 - RNA, 19 nt, Artificial Sequence
  Synthetic
ccauggaaccagacagaaa

SEQ ID NO: 524 - RNA, 19 nt, Artificial Sequence
  Synthetic
gaaacggcuuucaguugag

SEQ ID NO: 525 - RNA, 19 nt, Artificial Sequence
  Synthetic
gggauauguauggguaggg

SEQ ID NO: 526 - RNA, 19 nt, Artificial Sequence
  Synthetic
uugggacucuuguucagcu

SEQ ID NO: 527 - RNA, 19 nt, Artificial Sequence
  Synthetic
uauguucccugagacauua

SEQ ID NO: 528 - RNA, 19 nt, Artificial Sequence
  Synthetic
ggacucucaggaaucuuuc

SEQ ID NO: 529 - RNA, 19 nt, Artificial Sequence
  Synthetic
aagcugcagaagcuauuga

SEQ ID NO: 530 - RNA, 19 nt, Artificial Sequence
  Synthetic
gcccuucacauccuagcuc

SEQ ID NO: 531 - RNA, 19 nt, Artificial Sequence
  Synthetic
agagauggcccagaaugca

SEQ ID NO: 532 - RNA, 19 nt, Artificial Sequence
  Synthetic
gcaauccugaggaagagga

SEQ ID NO: 533 - RNA, 19 nt, Artificial Sequence
  Synthetic
caggaugccuuggguaugg

SEQ ID NO: 534 - RNA, 19 nt, Artificial Sequence
  Synthetic
cugcuauguucccugagac

SEQ ID NO: 535 - RNA, 19 nt, Artificial Sequence
  Synthetic
uucacaaccgaauuguuau

SEQ ID NO: 536 - RNA, 19 nt, Artificial Sequence
  Synthetic
aaagcaagcucaucauacu

SEQ ID NO: 537 - RNA, 19 nt, Artificial Sequence
  Synthetic
aggcaauccugaggaagag

SEQ ID NO: 538 - RNA, 19 nt, Artificial Sequence
  Synthetic
uguuugugcagcugcuuua

SEQ ID NO: 539 - RNA, 19 nt, Artificial Sequence
  Synthetic
ggaaugcaagcuuuaggac

SEQ ID NO: 540 - RNA, 19 nt, Artificial Sequence
  Synthetic
ccggcuauuguagaagcug

SEQ ID NO: 541 - RNA, 19 nt, Artificial Sequence
  Synthetic
aauaagccggcuauuguag

SEQ ID NO: 542 - RNA, 19 nt, Artificial Sequence
  Synthetic
ucagcuucuggguucagau

SEQ ID NO: 543 - RNA, 19 nt, Artificial Sequence
  Synthetic
ccuguaugagugggaacag

SEQ ID NO: 544 - RNA, 19 nt, Artificial Sequence
  Synthetic
cacucaagaacaaguagcu

SEQ ID NO: 545 - RNA, 19 nt, Artificial Sequence
  Synthetic
ccuucacauccuagcucgg

SEQ ID NO: 546 - RNA, 19 nt, Artificial Sequence
  Synthetic
augcaccuuugcgugagca

SEQ ID NO: 547 - RNA, 19 nt, Artificial Sequence
  Synthetic
uguucgugcacaucaggau

SEQ ID NO: 548 - RNA, 19 nt, Artificial Sequence
  Synthetic
ucaguugcuuguucgugca

SEQ ID NO: 549 - RNA, 19 nt, Artificial Sequence
  Synthetic
cccgcaaaucaugcaccuu

SEQ ID NO: 550 - RNA, 19 nt, Artificial Sequence
  Synthetic
gcugauuugauggaguugg

SEQ ID NO: 551 - RNA, 19 nt, Artificial Sequence
  Synthetic
auagaggcucuugugcgua

SEQ ID NO: 552 - RNA, 19 nt, Artificial Sequence
  Synthetic
caggacaaggaagcugcag

SEQ ID NO: 553 - RNA, 19 nt, Artificial Sequence
  Synthetic
agcucuuacacccaccauc

SEQ ID NO: 554 - RNA, 19 nt, Artificial Sequence
  Synthetic
caucacagaugcugaaaca

SEQ ID NO: 555 - RNA, 19 nt, Artificial Sequence
  Synthetic
cuauuguagaagcuggugg

SEQ ID NO: 556 - RNA, 19 nt, Artificial Sequence
  Synthetic
augcccaggaccucaugga

SEQ ID NO: 557 - RNA, 19 nt, Artificial Sequence
  Synthetic
ugacucgagcucagagggu

SEQ ID NO: 558 - RNA, 19 nt, Artificial Sequence
  Synthetic
aguuugaugcugcucaucc

SEQ ID NO: 559 - RNA, 19 nt, Artificial Sequence
  Synthetic
uccuucgggcuggugacag

SEQ ID NO: 560 - RNA, 19 nt, Artificial Sequence
  Synthetic
augaagguguggcgacaua

SEQ ID NO: 561 - RNA, 19 nt, Artificial Sequence
  Synthetic
aguugagcugaccagcucu

SEQ ID NO: 562 - RNA, 19 nt, Artificial Sequence
  Synthetic
cuguaugagugggaacagg

SEQ ID NO: 563 - RNA, 19 nt, Artificial Sequence
  Synthetic
cucagaggguacgagcugc

SEQ ID NO: 564 - RNA, 19 nt, Artificial Sequence
  Synthetic
ggcaauccugaggaagagg

SEQ ID NO: 565 - RNA, 19 nt, Artificial Sequence
  Synthetic
cauacuggcuaguggugga

SEQ ID NO: 566 - RNA, 19 nt, Artificial Sequence
  Synthetic
acaagccacaagauuacaa

SEQ ID NO: 567 - RNA, 19 nt, Artificial Sequence
  Synthetic
gcucuugugcguacugucc

SEQ ID NO: 568 - RNA, 19 nt, Artificial Sequence
  Synthetic
auguggauaccucccaagu

SEQ ID NO: 569 - RNA, 19 nt, Artificial Sequence
  Synthetic
uuguuugugcagcugcuuu

SEQ ID NO: 570 - RNA, 19 nt, Artificial Sequence
  Synthetic
acauaugcagcugcuguuu

SEQ ID NO: 571 - RNA, 19 nt, Artificial Sequence
  Synthetic
ucaguccuucacucaagaa

SEQ ID NO: 572 - RNA, 19 nt, Artificial Sequence
  Synthetic
accuugcauaaccuuuccc

SEQ ID NO: 573 - RNA, 19 nt, Artificial Sequence
  Synthetic
ggcgacauaugcagcugcu

SEQ ID NO: 574 - RNA, 19 nt, Artificial Sequence
  Synthetic
uggugucugcuauuguacg

SEQ ID NO: 575 - RNA, 19 nt, Artificial Sequence
  Synthetic
guucccugagacauuagau

SEQ ID NO: 576 - RNA, 19 nt, Artificial Sequence
  Synthetic
auaaaggcuacuguuggau

SEQ ID NO: 577 - RNA, 19 nt, Artificial Sequence
  Synthetic
gugccauuccacgacuagu

SEQ ID NO: 578 - RNA, 19 nt, Artificial Sequence
  Synthetic
ugggugguauagaggcucu

SEQ ID NO: 579 - RNA, 19 nt, Artificial Sequence
  Synthetic
ggccaucuuuaagucugga

SEQ ID NO: 580 - RNA, 19 nt, Artificial Sequence
  Synthetic
uauuggugcccagggagaa

SEQ ID NO: 581 - RNA, 19 nt, Artificial Sequence
  Synthetic
cucgagcucagaggguacg

SEQ ID NO: 582 - RNA, 19 nt, Artificial Sequence
  Synthetic
agaacuugccacacgugca

SEQ ID NO: 583 - RNA, 19 nt, Artificial Sequence
  Synthetic
uaccaguugugguuaagcu

SEQ ID NO: 584 - RNA, 19 nt, Artificial Sequence
  Synthetic
cguuuggcugaaccaucac

SEQ ID NO: 585 - RNA, 19 nt, Artificial Sequence
  Synthetic
gcuauuguagaagcuggug

SEQ ID NO: 586 - RNA, 19 nt, Artificial Sequence
  Synthetic
ggaggcauuccugcccugg

SEQ ID NO: 587 - RNA, 19 nt, Artificial Sequence
  Synthetic
accacccuggugcugacua

SEQ ID NO: 588 - RNA, 19 nt, Artificial Sequence
  Synthetic
aaucuugcccuuugucccg

SEQ ID NO: 589 - RNA, 19 nt, Artificial Sequence
  Synthetic
cguuuagcuggugggcugc

SEQ ID NO: 590 - RNA, 19 nt, Artificial Sequence
  Synthetic
caguugagcugaccagcuc

SEQ ID NO: 591 - RNA, 19 nt, Artificial Sequence
  Synthetic
ugauauaaauguggucacc

SEQ ID NO: 592 - RNA, 19 nt, Artificial Sequence
  Synthetic
cugagugguaaaggcaauc

SEQ ID NO: 593 - RNA, 19 nt, Artificial Sequence
  Synthetic
aaggugcuaucugucugcu

SEQ ID NO: 594 - RNA, 19 nt, Artificial Sequence
  Synthetic
uccuagcucgggauguuca

SEQ ID NO: 595 - RNA, 19 nt, Artificial Sequence
  Synthetic
ucaagcugauuugauggag

SEQ ID NO: 596 - RNA, 19 nt, Artificial Sequence
  Synthetic
ccagcucucucuucagaac

SEQ ID NO: 597 - RNA, 19 nt, Artificial Sequence
  Synthetic
acauggccauggaaccaga

SEQ ID NO: 598 - RNA, 19 nt, Artificial Sequence
  Synthetic
uacccagcgccguacgucc

SEQ ID NO: 599 - RNA, 19 nt, Artificial Sequence
  Synthetic
auaguugaagguuguaccg

SEQ ID NO: 600 - RNA, 19 nt, Artificial Sequence
  Synthetic
agcuuuaggacuucaccug

SEQ ID NO: 601 - RNA, 19 nt, Artificial Sequence
  Synthetic
acauccaaagaguagcugc

SEQ ID NO: 602 - RNA, 19 nt, Artificial Sequence
  Synthetic
uugcauaaccuuucccauc

SEQ ID NO: 603 - RNA, 19 nt, Artificial Sequence
  Synthetic
uggcccagaaugcaguucg

SEQ ID NO: 604 - RNA, 19 nt, Artificial Sequence
  Synthetic
auucgaaaucuugcccuuu

SEQ ID NO: 605 - RNA, 19 nt, Artificial Sequence
  Synthetic
auaagccggcuauuguaga

SEQ ID NO: 606 - RNA, 19 nt, Artificial Sequence
  Synthetic
cgacagacugccuucaaau

SEQ ID NO: 607 - RNA, 19 nt, Artificial Sequence
  Synthetic
ugcaguuaugguccaucag

SEQ ID NO: 608 - RNA, 19 nt, Artificial Sequence
  Synthetic
guuugaugcugcucauccc

SEQ ID NO: 609 - RNA, 19 nt, Artificial Sequence
  Synthetic
cuaauguccagcguuuggc

SEQ ID NO: 610 - RNA, 19 nt, Artificial Sequence
  Synthetic
caaguagcugauauugaug

SEQ ID NO: 611 - RNA, 19 nt, Artificial Sequence
  Synthetic
ucugacagaguuacuucac

SEQ ID NO: 612 - RNA, 19 nt, Artificial Sequence
  Synthetic
ggugguauagaggcucuug

SEQ ID NO: 613 - RNA, 19 nt, Artificial Sequence
  Synthetic
gaccagguggugguuaaua

SEQ ID NO: 614 - RNA, 19 nt, Artificial Sequence
  Synthetic
ccucauggaugggcugccu

SEQ ID NO: 615 - RNA, 19 nt, Artificial Sequence
  Synthetic
ugucuuuggacucucagga

SEQ ID NO: 616 - RNA, 19 nt, Artificial Sequence
  Synthetic
gaacaaguagcugauauug

SEQ ID NO: 617 - RNA, 19 nt, Artificial Sequence
  Synthetic
gugccacuaccacagcucc

SEQ ID NO: 618 - RNA, 19 nt, Artificial Sequence
  Synthetic
gcaccuuugcgugagcagg

SEQ ID NO: 619 - RNA, 19 nt, Artificial Sequence
  Synthetic
gacuucaccugacagaucc

SEQ ID NO: 620 - RNA, 19 nt, Artificial Sequence
  Synthetic
aaauaccauuccauuguuu

SEQ ID NO: 621 - RNA, 19 nt, Artificial Sequence
  Synthetic
cucaagaacaaguagcuga

SEQ ID NO: 622 - RNA, 19 nt, Artificial Sequence
  Synthetic
uccucugugaacuugcuca

SEQ ID NO: 623 - RNA, 19 nt, Artificial Sequence
  Synthetic
ucuggaggcauuccugccc

SEQ ID NO: 624 - RNA, 19 nt, Artificial Sequence
  Synthetic
aagucuggaggcauuccug

SEQ ID NO: 625 - RNA, 19 nt, Artificial Sequence
  Synthetic
uugaagguuguaccggagc

SEQ ID NO: 626 - RNA, 19 nt, Artificial Sequence
  Synthetic
acauccuagcucgggaugu

SEQ ID NO: 627 - RNA, 19 nt, Artificial Sequence
  Synthetic
accaagaaagcaagcucau

SEQ ID NO: 628 - RNA, 19 nt, Artificial Sequence
  Synthetic
uuuggcugaaccaucacag

SEQ ID NO: 629 - RNA, 19 nt, Artificial Sequence
  Synthetic
cacacgugcaaucccugaa

SEQ ID NO: 630 - RNA, 19 nt, Artificial Sequence
  Synthetic
gcucaucauacuggcuagu

SEQ ID NO: 631 - RNA, 19 nt, Artificial Sequence
  Synthetic
ggguaggguaaaucaguaa

SEQ ID NO: 632 - RNA, 19 nt, Artificial Sequence
  Synthetic
uucaccugacagauccaag

SEQ ID NO: 633 - RNA, 19 nt, Artificial Sequence
  Synthetic
ugguaaaggcaauccugag

SEQ ID NO: 634 - RNA, 19 nt, Artificial Sequence
  Synthetic
gauccuagcuaucguucuu

SEQ ID NO: 635 - RNA, 19 nt, Artificial Sequence
  Synthetic
uucgucaucugaccagccg

SEQ ID NO: 636 - RNA, 19 nt, Artificial Sequence
  Synthetic
aaucuuucagaugcugcaa

SEQ ID NO: 637 - RNA, 19 nt, Artificial Sequence
  Synthetic
ugcaguucgccuucacuau

SEQ ID NO: 638 - RNA, 19 nt, Artificial Sequence
  Synthetic
aggaugauccuagcuaucg

SEQ ID NO: 639 - RNA, 19 nt, Artificial Sequence
  Synthetic
cagcucucucuucagaaca

SEQ ID NO: 640 - RNA, 19 nt, Artificial Sequence
  Synthetic
ggugggacacagcagcaau

SEQ ID NO: 641 - RNA, 19 nt, Artificial Sequence
  Synthetic
caggaugauccuagcuauc

SEQ ID NO: 642 - RNA, 19 nt, Artificial Sequence
  Synthetic
aggaagaggauguggauac

SEQ ID NO: 643 - RNA, 19 nt, Artificial Sequence
  Synthetic
aucugucugcucuaguaau

SEQ ID NO: 644 - RNA, 19 nt, Artificial Sequence
  Synthetic
uaaccuuucccaucaucgu

SEQ ID NO: 645 - RNA, 19 nt, Artificial Sequence
  Synthetic
cugcuuuauucucccauug

SEQ ID NO: 646 - RNA, 19 nt, Artificial Sequence
  Synthetic
aauuguaaucugaauaaag

SEQ ID NO: 647 - RNA, 19 nt, Artificial Sequence
  Synthetic
ucuuguucagcuucugggu

SEQ ID NO: 648 - RNA, 19 nt, Artificial Sequence
  Synthetic
guucgugcacaucaggaua

SEQ ID NO: 649 - RNA, 19 nt, Artificial Sequence
  Synthetic
augaugcagaacuugccac

SEQ ID NO: 650 - RNA, 19 nt, Artificial Sequence
  Synthetic
gcugauauugauggacagu

SEQ ID NO: 651 - RNA, 19 nt, Artificial Sequence
  Synthetic
gguuaagcucuuacaccca

SEQ ID NO: 652 - RNA, 19 nt, Artificial Sequence
  Synthetic
gcccuuugucccgcaaauc

SEQ ID NO: 653 - RNA, 19 nt, Artificial Sequence
  Synthetic
ucagaggguacgagcugcu

SEQ ID NO: 654 - RNA, 19 nt, Artificial Sequence
  Synthetic
aaacaugcaguuguaaacu

SEQ ID NO: 655 - RNA, 19 nt, Artificial Sequence
  Synthetic
cuugcccuuugucccgcaa

SEQ ID NO: 656 - RNA, 19 nt, Artificial Sequence
  Synthetic
uuacaagaaacggcuuuca

SEQ ID NO: 657 - RNA, 19 nt, Artificial Sequence
  Synthetic
cacucugguggauauggcc

SEQ ID NO: 658 - RNA, 19 nt, Artificial Sequence
  Synthetic
caucuuuaagucuggaggc

SEQ ID NO: 659 - RNA, 19 nt, Artificial Sequence
  Synthetic
ugccaucugugcucuucgu

SEQ ID NO: 660 - RNA, 19 nt, Artificial Sequence
  Synthetic
ucuuggcuauuacgacaga

SEQ ID NO: 661 - RNA, 19 nt, Artificial Sequence
  Synthetic
auuugggauauguaugggu

SEQ ID NO: 662 - RNA, 19 nt, Artificial Sequence
  Synthetic
caguggauucuguguuguu

SEQ ID NO: 663 - RNA, 19 nt, Artificial Sequence
  Synthetic
ccuucgggcuggugacagg

SEQ ID NO: 664 - RNA, 19 nt, Artificial Sequence
  Synthetic
ggacacagcagcaauuugu

SEQ ID NO: 665 - RNA, 19 nt, Artificial Sequence
  Synthetic
ccagcgccguacguccaug

SEQ ID NO: 666 - RNA, 19 nt, Artificial Sequence
  Synthetic
aagaaacggcuuucaguug

SEQ ID NO: 667 - RNA, 19 nt, Artificial Sequence
  Synthetic
auuagaugagggcaugcag

SEQ ID NO: 668 - RNA, 19 nt, Artificial Sequence
  Synthetic
accagcucucucuucagaa

SEQ ID NO: 669 - RNA, 19 nt, Artificial Sequence
  Synthetic
aguuaugguccaucagcuu

SEQ ID NO: 670 - RNA, 19 nt, Artificial Sequence
  Synthetic
gacuauccaguugaugggc

SEQ ID NO: 671 - RNA, 19 nt, Artificial Sequence
  Synthetic
augcuugguucaccagugg

SEQ ID NO: 672 - RNA, 19 nt, Artificial Sequence
  Synthetic
cuagcucgggauguucaca

SEQ ID NO: 673 - RNA, 19 nt, Artificial Sequence
  Synthetic
cucuuacacccaccauccc

SEQ ID NO: 674 - RNA, 19 nt, Artificial Sequence
  Synthetic
cuugcucaggacaaggaag

SEQ ID NO: 675 - RNA, 19 nt, Artificial Sequence
  Synthetic
agauuacaagaaacggcuu

SEQ ID NO: 676 - RNA, 19 nt, Artificial Sequence
  Synthetic
accacagcuccuucucuga

SEQ ID NO: 677 - RNA, 19 nt, Artificial Sequence
  Synthetic
agaugcugcaacuaaacag

SEQ ID NO: 678 - RNA, 19 nt, Artificial Sequence
  Synthetic
uuaagcucuuacacccacc

SEQ ID NO: 679 - RNA, 19 nt, Artificial Sequence
  Synthetic
aauaaggcugcaguuaugg

SEQ ID NO: 680 - RNA, 19 nt, Artificial Sequence
  Synthetic
uugggauauguauggguag

SEQ ID NO: 681 - RNA, 19 nt, Artificial Sequence
  Synthetic
guaaccugcugugauacga

SEQ ID NO: 682 - RNA, 19 nt, Artificial Sequence
  Synthetic
uggucugccaagugggugg

SEQ ID NO: 683 - RNA, 19 nt, Artificial Sequence
  Synthetic
ccuucucugagugguaaag

SEQ ID NO: 684 - RNA, 19 nt, Artificial Sequence
  Synthetic
gaagcuauugaagcugagg

SEQ ID NO: 685 - RNA, 19 nt, Artificial Sequence
  Synthetic
augcagaacuugccacacg

SEQ ID NO: 686 - RNA, 19 nt, Artificial Sequence
  Synthetic
guagcugauauugauggac

SEQ ID NO: 687 - RNA, 19 nt, Artificial Sequence
  Synthetic
cucaagcugauuugaugga

SEQ ID NO: 688 - RNA, 19 nt, Artificial Sequence
  Synthetic
gcauggaagaaauaguuga

SEQ ID NO: 689 - RNA, 19 nt, Artificial Sequence
  Synthetic
cugguggaaugcaagcuuu

SEQ ID NO: 690 - RNA, 19 nt, Artificial Sequence
  Synthetic
cccaggaccucauggaugg

SEQ ID NO: 691 - RNA, 19 nt, Artificial Sequence
  Synthetic
uuugggauauguaugggua

SEQ ID NO: 692 - RNA, 19 nt, Artificial Sequence
  Synthetic
caaaguuguuguaaccugc

SEQ ID NO: 693 - RNA, 19 nt, Artificial Sequence
  Synthetic
ccgaauuguuaucagagga

SEQ ID NO: 694 - RNA, 19 nt, Artificial Sequence
  Synthetic
uaauuguaaucugaauaaa

SEQ ID NO: 695 - RNA, 19 nt, Artificial Sequence
  Synthetic
auuguaaucugaauaaagu

SEQ ID NO: 696 - RNA, 19 nt, Artificial Sequence
  Synthetic
cgaauuguuaucagaggac

SEQ ID NO: 697 - RNA, 19 nt, Artificial Sequence
  Synthetic
ccaaguccuguaugagugg

SEQ ID NO: 698 - RNA, 19 nt, Artificial Sequence
  Synthetic
aagccggcuauuguagaag

SEQ ID NO: 699 - RNA, 19 nt, Artificial Sequence
  Synthetic
auccuagcuaucguucuuu

SEQ ID NO: 700 - RNA, 19 nt, Artificial Sequence
  Synthetic
auaaccuuucccaucaucg

SEQ ID NO: 701 - RNA, 19 nt, Artificial Sequence
  Synthetic
gccaagugggugguauaga

SEQ ID NO: 702 - RNA, 19 nt, Artificial Sequence
  Synthetic
cgacuaguucaguugcuug

SEQ ID NO: 703 - RNA, 19 nt, Artificial Sequence
  Synthetic
uugguucaccaguggauuc

SEQ ID NO: 704 - RNA, 19 nt, Artificial Sequence
  Synthetic
guucagaacugucuuugga

SEQ ID NO: 705 - RNA, 19 nt, Artificial Sequence
  Synthetic
ugcugugauacgaugcuuc

SEQ ID NO: 706 - RNA, 19 nt, Artificial Sequence
  Synthetic
uccaggugacagcaaucag

SEQ ID NO: 707 - RNA, 19 nt, Artificial Sequence
  Synthetic
uaugguccaucagcuuucu

SEQ ID NO: 708 - RNA, 19 nt, Artificial Sequence
  Synthetic
ugccauuccacgacuaguu

SEQ ID NO: 709 - RNA, 19 nt, Artificial Sequence
  Synthetic
aaccaagaaagcaagcuca

SEQ ID NO: 710 - RNA, 19 nt, Artificial Sequence
  Synthetic
auaauuauaagaacaagau

SEQ ID NO: 711 - RNA, 19 nt, Artificial Sequence
  Synthetic
guuaagcucuuacacccac

SEQ ID NO: 712 - RNA, 19 nt, Artificial Sequence
  Synthetic
uugaguaaugguguagaac

SEQ ID NO: 713 - RNA, 19 nt, Artificial Sequence
  Synthetic
guguggcgacauaugcagc

SEQ ID NO: 714 - RNA, 19 nt, Artificial Sequence
  Synthetic
gaccagcucucucuucaga

SEQ ID NO: 715 - RNA, 19 nt, Artificial Sequence
  Synthetic
uuguaccggagcccuucac

SEQ ID NO: 716 - RNA, 19 nt, Artificial Sequence
  Synthetic
auggccauggaaccagaca

SEQ ID NO: 717 - RNA, 19 nt, Artificial Sequence
  Synthetic
ugguggauauggccaggau

SEQ ID NO: 718 - RNA, 19 nt, Artificial Sequence
  Synthetic
ccucugacagaguuacuuc

SEQ ID NO: 719 - RNA, 19 nt, Artificial Sequence
  Synthetic
augauccuagcuaucguuc

SEQ ID NO: 720 - RNA, 19 nt, Artificial Sequence
  Synthetic
augguccaucagcuuucua

SEQ ID NO: 721 - RNA, 19 nt, Artificial Sequence
  Synthetic
ggacucuuguucagcuucu

SEQ ID NO: 722 - RNA, 19 nt, Artificial Sequence
  Synthetic
gcuaucaugcguucuccuc

SEQ ID NO: 723 - RNA, 19 nt, Artificial Sequence
  Synthetic
gcugaccagcucucucuuc

SEQ ID NO: 724 - RNA, 19 nt, Artificial Sequence
  Synthetic
ucgugcacaucaggauacc

SEQ ID NO: 725 - RNA, 19 nt, Artificial Sequence
  Synthetic
uacuucacucuaggaauga

SEQ ID NO: 726 - RNA, 19 nt, Artificial Sequence
  Synthetic
ugaaacaugcaguuguaaa

SEQ ID NO: 727 - RNA, 19 nt, Artificial Sequence
  Synthetic
uaugccauuacaacucucc

SEQ ID NO: 728 - RNA, 19 nt, Artificial Sequence
  Synthetic
uguuaucagaggacuaaau

SEQ ID NO: 729 - RNA, 19 nt, Artificial Sequence
  Synthetic
gauggaaggucuccuuggg

SEQ ID NO: 730 - RNA, 19 nt, Artificial Sequence
  Synthetic
cauccaaagaguagcugca

SEQ ID NO: 731 - RNA, 19 nt, Artificial Sequence
  Synthetic
gccgacaccaagaagcaga

SEQ ID NO: 732 - RNA, 19 nt, Artificial Sequence
  Synthetic
cuuuggacucucaggaauc

SEQ ID NO: 733 - RNA, 19 nt, Artificial Sequence
  Synthetic
ggaacaugagauggguggc

SEQ ID NO: 734 - RNA, 19 nt, Artificial Sequence
  Synthetic
uggcagugcguuuagcugg

SEQ ID NO: 735 - RNA, 19 nt, Artificial Sequence
  Synthetic
ggaagcugcagaagcuauu

SEQ ID NO: 736 - RNA, 19 nt, Artificial Sequence
  Synthetic
cucuaggaaugaaggugug

SEQ ID NO: 737 - RNA, 19 nt, Artificial Sequence
  Synthetic
guacgagcugcuauguucc

SEQ ID NO: 738 - RNA, 19 nt, Artificial Sequence
  Synthetic
uccacgacuaguucaguug

SEQ ID NO: 739 - RNA, 19 nt, Artificial Sequence
  Synthetic
ccucagauggugucugcua

SEQ ID NO: 740 - RNA, 19 nt, Artificial Sequence
  Synthetic
cucugugaacuugcucagg

SEQ ID NO: 741 - RNA, 19 nt, Artificial Sequence
  Synthetic
gcaguuaugguccaucagc

SEQ ID NO: 742 - RNA, 19 nt, Artificial Sequence
  Synthetic
ucuuacacccaccauccca

SEQ ID NO: 743 - RNA, 19 nt, Artificial Sequence
  Synthetic
cgccaggaugauccuagcu

SEQ ID NO: 744 - RNA, 19 nt, Artificial Sequence
  Synthetic
caccugacagauccaaguc

SEQ ID NO: 745 - RNA, 19 nt, Artificial Sequence
  Synthetic
ucaccugugcagcuggaau

SEQ ID NO: 746 - RNA, 19 nt, Artificial Sequence
  Synthetic
ggaugggcugccuccaggu

SEQ ID NO: 747 - RNA, 19 nt, Artificial Sequence
  Synthetic
uaccggagcccuucacauc

SEQ ID NO: 748 - RNA, 19 nt, Artificial Sequence
  Synthetic
ugagacauuagaugagggc

SEQ ID NO: 749 - RNA, 19 nt, Artificial Sequence
  Synthetic
cacucuaggaaugaaggug

SEQ ID NO: 750 - RNA, 19 nt, Artificial Sequence
  Synthetic
uugaugcugcucaucccac

SEQ ID NO: 751 - RNA, 19 nt, Artificial Sequence
  Synthetic
uucucugagugguaaaggc

SEQ ID NO: 752 - RNA, 19 nt, Artificial Sequence
  Synthetic
uguuagucacuggcagcaa

SEQ ID NO: 753 - RNA, 19 nt, Artificial Sequence
  Synthetic
gaagaaauaguugaagguu

SEQ ID NO: 754 - RNA, 19 nt, Artificial Sequence
  Synthetic
cuucacucuaggaaugaag

SEQ ID NO: 755 - RNA, 19 nt, Artificial Sequence
  Synthetic
cuggguucagaugauauaa

SEQ ID NO: 756 - RNA, 19 nt, Artificial Sequence
  Synthetic
ggacaagccacaagauuac

SEQ ID NO: 757 - RNA, 19 nt, Artificial Sequence
  Synthetic
acccuggugcugacuaucc

SEQ ID NO: 758 - RNA, 19 nt, Artificial Sequence
  Synthetic
uugauauuggugcccaggg

SEQ ID NO: 759 - RNA, 19 nt, Artificial Sequence
  Synthetic
accucccaaguccuguaug

SEQ ID NO: 760 - RNA, 19 nt, Artificial Sequence
  Synthetic
guaugcaaugacucgagcu

SEQ ID NO: 761 - RNA, 19 nt, Artificial Sequence
  Synthetic
ccaguugugguuaagcucu

SEQ ID NO: 762 - RNA, 19 nt, Artificial Sequence
  Synthetic
augacucgagcucagaggg

SEQ ID NO: 763 - RNA, 19 nt, Artificial Sequence
  Synthetic
uuguuguaaccugcuguga

SEQ ID NO: 764 - RNA, 19 nt, Artificial Sequence
  Synthetic
ccaagucaacgucuuguuc

SEQ ID NO: 765 - RNA, 19 nt, Artificial Sequence
  Synthetic
aucagaggacuaaauacca

SEQ ID NO: 766 - RNA, 19 nt, Artificial Sequence
  Synthetic
uguauggguaggguaaauc

SEQ ID NO: 767 - RNA, 19 nt, Artificial Sequence
  Synthetic
cgugagcagggugccauuc

SEQ ID NO: 768 - RNA, 19 nt, Artificial Sequence
  Synthetic
ugaugggcugccagaucug

SEQ ID NO: 769 - RNA, 19 nt, Artificial Sequence
  Synthetic
cuuguucgugcacaucagg

SEQ ID NO: 770 - RNA, 19 nt, Artificial Sequence
  Synthetic
ccaucacagaugcugaaac

SEQ ID NO: 771 - RNA, 19 nt, Artificial Sequence
  Synthetic
acaguuuaccaguugccuu

SEQ ID NO: 772 - RNA, 19 nt, Artificial Sequence
  Synthetic
accgaauuguuaucagagg

SEQ ID NO: 773 - RNA, 19 nt, Artificial Sequence
  Synthetic
gcagugcguuuagcuggug

SEQ ID NO: 774 - RNA, 19 nt, Artificial Sequence
  Synthetic
aacaugagauggguggcca

SEQ ID NO: 775 - RNA, 19 nt, Artificial Sequence
  Synthetic
ccugacagauccaagucaa

SEQ ID NO: 776 - RNA, 19 nt, Artificial Sequence
  Synthetic
gggauguucacaaccgaau

SEQ ID NO: 777 - RNA, 19 nt, Artificial Sequence
  Synthetic
ggauugauucgaaaucuug

SEQ ID NO: 778 - RNA, 19 nt, Artificial Sequence
  Synthetic
gaagcugcagaagcuauug

SEQ ID NO: 779 - RNA, 19 nt, Artificial Sequence
  Synthetic
aaugacucgagcucagagg

SEQ ID NO: 780 - RNA, 19 nt, Artificial Sequence
  Synthetic
uuguucagcuucuggguuc

SEQ ID NO: 781 - RNA, 19 nt, Artificial Sequence
  Synthetic
ccucacuugcaauaauuau

SEQ ID NO: 782 - RNA, 19 nt, Artificial Sequence
  Synthetic
cagauggugucugcuauug

SEQ ID NO: 783 - RNA, 19 nt, Artificial Sequence
  Synthetic
cuucacucaagaacaagua

SEQ ID NO: 784 - RNA, 19 nt, Artificial Sequence
  Synthetic
aucacagaugcugaaacau

SEQ ID NO: 785 - RNA, 19 nt, Artificial Sequence
  Synthetic
aguucgccuucacuaugga

SEQ ID NO: 786 - RNA, 19 nt, Artificial Sequence
  Synthetic
uacuggccaucuuuaaguc

SEQ ID NO: 787 - RNA, 19 nt, Artificial Sequence
  Synthetic
caagcuuuaguaaauauaa

SEQ ID NO: 788 - RNA, 19 nt, Artificial Sequence
  Synthetic
agccacaagauuacaagaa

SEQ ID NO: 789 - RNA, 19 nt, Artificial Sequence
  Synthetic
aagcagagauggcccagaa

SEQ ID NO: 790 - RNA, 19 nt, Artificial Sequence
  Synthetic
gaugcagaacuugccacac

SEQ ID NO: 791 - RNA, 19 nt, Artificial Sequence
  Synthetic
aucuuucagaugcugcaac

SEQ ID NO: 792 - RNA, 19 nt, Artificial Sequence
  Synthetic
ugggacacagcagcaauuu

SEQ ID NO: 793 - RNA, 19 nt, Artificial Sequence
  Synthetic
acagauccaagucaacguc

SEQ ID NO: 794 - RNA, 19 nt, Artificial Sequence
  Synthetic
acagcagcaauuuguggag

SEQ ID NO: 795 - RNA, 19 nt, Artificial Sequence
  Synthetic
ugcaacuaaacaggaaggg

SEQ ID NO: 796 - RNA, 19 nt, Artificial Sequence
  Synthetic
gcucaggacaaggaagcug

SEQ ID NO: 797 - RNA, 19 nt, Artificial Sequence
  Synthetic
gacuaaauaccauuccauu

SEQ ID NO: 798 - RNA, 19 nt, Artificial Sequence
  Synthetic
uuugaugcugcucauccca

SEQ ID NO: 799 - RNA, 19 nt, Artificial Sequence
  Synthetic
uggcagcaacagucuuacc

SEQ ID NO: 800 - RNA, 19 nt, Artificial Sequence
  Synthetic
aagaaagcaagcucaucau

SEQ ID NO: 801 - RNA, 19 nt, Artificial Sequence
  Synthetic
ugaucuuggacuugauauu

SEQ ID NO: 802 - RNA, 19 nt, Artificial Sequence
  Synthetic
cugaauaaaguguaacaau

SEQ ID NO: 803 - RNA, 19 nt, Artificial Sequence
  Synthetic
acuaaauaccauuccauug

SEQ ID NO: 804 - RNA, 19 nt, Artificial Sequence
  Synthetic
aucccacuaauguccagcg

SEQ ID NO: 805 - RNA, 19 nt, Artificial Sequence
  Synthetic
ccacuaccacagcuccuuc

SEQ ID NO: 806 - RNA, 19 nt, Artificial Sequence
  Synthetic
caucaggauacccagcgcc

SEQ ID NO: 807 - RNA, 19 nt, Artificial Sequence
  Synthetic
ucacagaugcugaaacaug

SEQ ID NO: 808 - RNA, 19 nt, Artificial Sequence
  Synthetic
uuugcgugagcagggugcc

SEQ ID NO: 809 - RNA, 19 nt, Artificial Sequence
  Synthetic
gcugaucuuggacuugaua

SEQ ID NO: 810 - RNA, 19 nt, Artificial Sequence
  Synthetic
ggcuauuacgacagacugc

SEQ ID NO: 811 - RNA, 19 nt, Artificial Sequence
  Synthetic
ggacauggccauggaacca

SEQ ID NO: 812 - RNA, 19 nt, Artificial Sequence
  Synthetic
aacaagaugauggucugcc

SEQ ID NO: 813 - RNA, 19 nt, Artificial Sequence
  Synthetic
uuacaucaagaaggagcua

SEQ ID NO: 814 - RNA, 19 nt, Artificial Sequence
  Synthetic
aaucaugcaccuuugcgug

SEQ ID NO: 815 - RNA, 19 nt, Artificial Sequence
  Synthetic
gcaaaucaugcaccuuugc

SEQ ID NO: 816 - RNA, 19 nt, Artificial Sequence
  Synthetic
gagugguaaaggcaauccu

SEQ ID NO: 817 - RNA, 19 nt, Artificial Sequence
  Synthetic
ucgccuucacuauggacua

SEQ ID NO: 818 - RNA, 19 nt, Artificial Sequence
  Synthetic
auccauucuggugccacua

SEQ ID NO: 819 - RNA, 19 nt, Artificial Sequence
  Synthetic
aucaggauacccagcgccg

SEQ ID NO: 820 - RNA, 19 nt, Artificial Sequence
  Synthetic
aguaugcaaugacucgagc

SEQ ID NO: 821 - RNA, 19 nt, Artificial Sequence
  Synthetic
cggcuuucaguugagcuga

SEQ ID NO: 822 - RNA, 19 nt, Artificial Sequence
  Synthetic
gcugcaguuaugguccauc

SEQ ID NO: 823 - RNA, 19 nt, Artificial Sequence
  Synthetic
auugaguaaugguguagaa

SEQ ID NO: 824 - RNA, 19 nt, Artificial Sequence
  Synthetic
guaaucugaauaaagugua

SEQ ID NO: 825 - RNA, 19 nt, Artificial Sequence
  Synthetic
uugauggacaguaugcaau

SEQ ID NO: 826 - RNA, 19 nt, Artificial Sequence
  Synthetic
gauauguauggguagggua

SEQ ID NO: 827 - RNA, 19 nt, Artificial Sequence
  Synthetic
gaacaagaugauggucugc

SEQ ID NO: 828 - RNA, 19 nt, Artificial Sequence
  Synthetic
uuaucagaggacuaaauac

SEQ ID NO: 829 - RNA, 19 nt, Artificial Sequence
  Synthetic
uucaccaguggauucugug

SEQ ID NO: 830 - RNA, 19 nt, Artificial Sequence
  Synthetic
aagguuguaccggagcccu

SEQ ID NO: 831 - RNA, 19 nt, Artificial Sequence
  Synthetic
guagaagcugguggaaugc

SEQ ID NO: 832 - RNA, 19 nt, Artificial Sequence
  Synthetic
augcugcaacuaaacagga

SEQ ID NO: 833 - RNA, 19 nt, Artificial Sequence
  Synthetic
ucacucugguggauauggc

SEQ ID NO: 834 - RNA, 19 nt, Artificial Sequence
  Synthetic
cugauuugauggaguugga

SEQ ID NO: 835 - RNA, 19 nt, Artificial Sequence
  Synthetic
ucaucauacuggcuagugg

SEQ ID NO: 836 - RNA, 19 nt, Artificial Sequence
  Synthetic
gcuuguucgugcacaucag

SEQ ID NO: 837 - RNA, 19 nt, Artificial Sequence
  Synthetic
ucugcucuaguaauaagcc

SEQ ID NO: 838 - RNA, 19 nt, Artificial Sequence
  Synthetic
uaucugucugcucuaguaa

SEQ ID NO: 839 - RNA, 19 nt, Artificial Sequence
  Synthetic
gcaagcucaucauacuggc

SEQ ID NO: 840 - RNA, 19 nt, Artificial Sequence
  Synthetic
agaggguacgagcugcuau

SEQ ID NO: 841 - RNA, 19 nt, Artificial Sequence
  Synthetic
ugugcguacuguccuucgg

SEQ ID NO: 842 - RNA, 19 nt, Artificial Sequence
  Synthetic
ggaagggauggaaggucuc

SEQ ID NO: 843 - RNA, 19 nt, Artificial Sequence
  Synthetic
augcguucuccucagaugg

SEQ ID NO: 844 - RNA, 19 nt, Artificial Sequence
  Synthetic
gacagaguuacuucacucu

SEQ ID NO: 845 - RNA, 19 nt, Artificial Sequence
  Synthetic
uuggcuauuacgacagacu

SEQ ID NO: 846 - RNA, 19 nt, Artificial Sequence
  Synthetic
ggacuaccaguugugguua

SEQ ID NO: 847 - RNA, 19 nt, Artificial Sequence
  Synthetic
uucagaacugucuuuggac

SEQ ID NO: 848 - RNA, 19 nt, Artificial Sequence
  Synthetic
aucugaccagccgacacca

SEQ ID NO: 849 - RNA, 19 nt, Artificial Sequence
  Synthetic
acacagcagcaauuugugg

SEQ ID NO: 850 - RNA, 19 nt, Artificial Sequence
  Synthetic
uaccacagcuccuucucug

SEQ ID NO: 851 - RNA, 19 nt, Artificial Sequence
  Synthetic
cguccaugggugggacaca

SEQ ID NO: 852 - RNA, 19 nt, Artificial Sequence
  Synthetic
ugugguuaagcucuuacac

SEQ ID NO: 853 - RNA, 19 nt, Artificial Sequence
  Synthetic
uuguacguaccaugcagaa

SEQ ID NO: 854 - RNA, 19 nt, Artificial Sequence
  Synthetic
gauacccagcgccguacgu

SEQ ID NO: 855 - RNA, 19 nt, Artificial Sequence
  Synthetic
ucaugcguucuccucagau

SEQ ID NO: 856 - RNA, 19 nt, Artificial Sequence
  Synthetic
gcacaucaggauacccagc

SEQ ID NO: 857 - RNA, 19 nt, Artificial Sequence
  Synthetic
gauuacaagaaacggcuuu

SEQ ID NO: 858 - RNA, 19 nt, Artificial Sequence
  Synthetic
acuaccaguugugguuaag

SEQ ID NO: 859 - RNA, 19 nt, Artificial Sequence
  Synthetic
gucuuguucagaacugucu

SEQ ID NO: 860 - RNA, 19 nt, Artificial Sequence
  Synthetic
ucaucugaccagccgacac

SEQ ID NO: 861 - RNA, 19 nt, Artificial Sequence
  Synthetic
cuuugcgugagcagggugc

SEQ ID NO: 862 - RNA, 19 nt, Artificial Sequence
  Synthetic
cugucuuuggacucucagg

SEQ ID NO: 863 - RNA, 19 nt, Artificial Sequence
  Synthetic
uacaucaagaaggagcuaa

SEQ ID NO: 864 - RNA, 19 nt, Artificial Sequence
  Synthetic
agauccaagucaacgucuu

SEQ ID NO: 865 - RNA, 19 nt, Artificial Sequence
  Synthetic
caagucaacgucuuguuca

SEQ ID NO: 866 - RNA, 19 nt, Artificial Sequence
  Synthetic
uccuugggacucuuguuca

SEQ ID NO: 867 - RNA, 19 nt, Artificial Sequence
  Synthetic
gguggaaugcaagcuuuag

SEQ ID NO: 868 - RNA, 19 nt, Artificial Sequence
  Synthetic
cugcaacuaaacaggaagg

SEQ ID NO: 869 - RNA, 19 nt, Artificial Sequence
  Synthetic
uuaggacuucaccugacag

SEQ ID NO: 870 - RNA, 19 nt, Artificial Sequence
  Synthetic
aguagcugauauugaugga

SEQ ID NO: 871 - RNA, 19 nt, Artificial Sequence
  Synthetic
uauaaugaggaccuauacu

SEQ ID NO: 872 - RNA, 19 nt, Artificial Sequence
  Synthetic
ccugcugugauacgaugcu

SEQ ID NO: 873 - RNA, 19 nt, Artificial Sequence
  Synthetic
auggguggccaccacccug

SEQ ID NO: 874 - RNA, 19 nt, Artificial Sequence
  Synthetic
gacucucaggaaucuuuca

SEQ ID NO: 875 - RNA, 19 nt, Artificial Sequence
  Synthetic
gugcacaucaggauaccca

SEQ ID NO: 876 - RNA, 19 nt, Artificial Sequence
  Synthetic
uuccagacacgcuaucaug

SEQ ID NO: 877 - RNA, 19 nt, Artificial Sequence
  Synthetic
uugccacacgugcaauccc

SEQ ID NO: 878 - RNA, 19 nt, Artificial Sequence
  Synthetic
ucagaugcugcaacuaaac

SEQ ID NO: 879 - RNA, 19 nt, Artificial Sequence
  Synthetic
cuuuaggacuucaccugac

SEQ ID NO: 880 - RNA, 19 nt, Artificial Sequence
  Synthetic
caugcaccuuugcgugagc

SEQ ID NO: 881 - RNA, 19 nt, Artificial Sequence
  Synthetic
acaacucuccacaaccuuu

SEQ ID NO: 882 - RNA, 19 nt, Artificial Sequence
  Synthetic
ugggacucuuguucagcuu

SEQ ID NO: 883 - RNA, 19 nt, Artificial Sequence
  Synthetic
gcuugguucaccaguggau

SEQ ID NO: 884 - RNA, 19 nt, Artificial Sequence
  Synthetic
uucccaucaucgugagggc

SEQ ID NO: 885 - RNA, 19 nt, Artificial Sequence
  Synthetic
gucugcucuaguaauaagc

SEQ ID NO: 886 - RNA, 19 nt, Artificial Sequence
  Synthetic
cagcuucuggguucagaug

SEQ ID NO: 887 - RNA, 19 nt, Artificial Sequence
  Synthetic
cgucaucugaccagccgac

SEQ ID NO: 888 - RNA, 19 nt, Artificial Sequence
  Synthetic
uguucccugagacauuaga

SEQ ID NO: 889 - RNA, 19 nt, Artificial Sequence
  Synthetic
gcaaccaagaaagcaagcu

SEQ ID NO: 890 - RNA, 19 nt, Artificial Sequence
  Synthetic
ggaguuggacauggccaug

SEQ ID NO: 891 - RNA, 19 nt, Artificial Sequence
  Synthetic
guccgcauggaagaaauag

SEQ ID NO: 892 - RNA, 19 nt, Artificial Sequence
  Synthetic
cugaucuuggacuugauau

SEQ ID NO: 893 - RNA, 19 nt, Artificial Sequence
  Synthetic
auggaaggucuccuuggga

SEQ ID NO: 894 - RNA, 19 nt, Artificial Sequence
  Synthetic
gauggucugccaagugggu

SEQ ID NO: 895 - RNA, 19 nt, Artificial Sequence
  Synthetic
acuaucaagaugaugcaga

SEQ ID NO: 896 - RNA, 19 nt, Artificial Sequence
  Synthetic
acagaugcugaaacaugca

SEQ ID NO: 897 - RNA, 19 nt, Artificial Sequence
  Synthetic
uucaguugagcugaccagc

SEQ ID NO: 898 - RNA, 19 nt, Artificial Sequence
  Synthetic
agaggcucuugugcguacu

SEQ ID NO: 899 - RNA, 19 nt, Artificial Sequence
  Synthetic
gguggauauggccaggaug

SEQ ID NO: 900 - RNA, 19 nt, Artificial Sequence
  Synthetic
cuugccacacgugcaaucc

SEQ ID NO: 901 - RNA, 19 nt, Artificial Sequence
  Synthetic
gaaugcaguucgccuucac

SEQ ID NO: 902 - RNA, 19 nt, Artificial Sequence
  Synthetic
ccuagcucgggauguucac

SEQ ID NO: 903 - RNA, 19 nt, Artificial Sequence
  Synthetic
uucacuauggacuaccagu

SEQ ID NO: 904 - RNA, 19 nt, Artificial Sequence
  Synthetic
gauggguggccaccacccu

SEQ ID NO: 905 - RNA, 19 nt, Artificial Sequence
  Synthetic
ugguuaauaaggcugcagu

SEQ ID NO: 906 - RNA, 19 nt, Artificial Sequence
  Synthetic
aucaagaugaugcagaacu

SEQ ID NO: 907 - RNA, 19 nt, Artificial Sequence
  Synthetic
cugcugugauacgaugcuu

SEQ ID NO: 908 - RNA, 19 nt, Artificial Sequence
  Synthetic
augccuuggguauggaccc

SEQ ID NO: 909 - RNA, 19 nt, Artificial Sequence
  Synthetic
ugugauacgaugcuucaag

SEQ ID NO: 910 - RNA, 19 nt, Artificial Sequence
  Synthetic
gagugcugaaggugcuauc

SEQ ID NO: 911 - RNA, 19 nt, Artificial Sequence
  Synthetic
gaggguacgagcugcuaug

SEQ ID NO: 912 - RNA, 19 nt, Artificial Sequence
  Synthetic
uuaauuguaaucugaauaa

SEQ ID NO: 913 - RNA, 19 nt, Artificial Sequence
  Synthetic
caccaagaagcagagaugg

SEQ ID NO: 914 - RNA, 19 nt, Artificial Sequence
  Synthetic
gaaugcaagcuuuaggacu

SEQ ID NO: 915 - RNA, 19 nt, Artificial Sequence
  Synthetic
accuuugcgugagcagggu

SEQ ID NO: 916 - RNA, 19 nt, Artificial Sequence
  Synthetic
aggugcuaucugucugcuc

SEQ ID NO: 917 - RNA, 19 nt, Artificial Sequence
  Synthetic
uugcucaggacaaggaagc

SEQ ID NO: 918 - RNA, 19 nt, Artificial Sequence
  Synthetic
gcugagggagccacagcuc

SEQ ID NO: 919 - RNA, 19 nt, Artificial Sequence
  Synthetic
cuaccacagcuccuucucu

SEQ ID NO: 920 - RNA, 19 nt, Artificial Sequence
  Synthetic
uggaacaugagaugggugg

SEQ ID NO: 921 - RNA, 19 nt, Artificial Sequence
  Synthetic
gcuauuguacguaccaugc

SEQ ID NO: 922 - RNA, 19 nt, Artificial Sequence
  Synthetic
ucuugcccuuugucccgca

SEQ ID NO: 923 - RNA, 19 nt, Artificial Sequence
  Synthetic
uuauaagaacaagaugaug

SEQ ID NO: 924 - RNA, 19 nt, Artificial Sequence
  Synthetic
ggaagcuuccagacacgcu

SEQ ID NO: 925 - RNA, 19 nt, Artificial Sequence
  Synthetic
uaagccggcuauuguagaa

SEQ ID NO: 926 - RNA, 19 nt, Artificial Sequence
  Synthetic
ggaccagguggugguuaau

SEQ ID NO: 927 - RNA, 19 nt, Artificial Sequence
  Synthetic
cugauauugauggacagua

SEQ ID NO: 928 - RNA, 19 nt, Artificial Sequence
  Synthetic
uggguaggguaaaucagua

SEQ ID NO: 929 - RNA, 19 nt, Artificial Sequence
  Synthetic
acuugauauuggugcccag

SEQ ID NO: 930 - RNA, 19 nt, Artificial Sequence
  Synthetic
uaagcucuuacacccacca

SEQ ID NO: 931 - RNA, 19 nt, Artificial Sequence
  Synthetic
cuacucaagcugauuugau

SEQ ID NO: 932 - RNA, 19 nt, Artificial Sequence
  Synthetic
ggugccauuccacgacuag

SEQ ID NO: 933 - RNA, 19 nt, Artificial Sequence
  Synthetic
uuggacauggccauggaac

SEQ ID NO: 934 - RNA, 19 nt, Artificial Sequence
  Synthetic
cugcucaucccacuaaugu

SEQ ID NO: 935 - RNA, 19 nt, Artificial Sequence
  Synthetic
cauggccauggaaccagac

SEQ ID NO: 936 - RNA, 19 nt, Artificial Sequence
  Synthetic
uauggcaaccaagaaagca

SEQ ID NO: 937 - RNA, 19 nt, Artificial Sequence
  Synthetic
accaguggauucuguguug

SEQ ID NO: 938 - RNA, 19 nt, Artificial Sequence
  Synthetic
acagaguuacuucacucua

SEQ ID NO: 939 - RNA, 19 nt, Artificial Sequence
  Synthetic
uaggacuucaccugacaga

SEQ ID NO: 940 - RNA, 19 nt, Artificial Sequence
  Synthetic
gccaggaugccuuggguau

SEQ ID NO: 941 - RNA, 19 nt, Artificial Sequence
  Synthetic
aaugaggaccuauacuuac

SEQ ID NO: 942 - RNA, 19 nt, Artificial Sequence
  Synthetic
auucuuggcuauuacgaca

SEQ ID NO: 943 - RNA, 19 nt, Artificial Sequence
  Synthetic
cuuuauucucccauugaaa

SEQ ID NO: 944 - RNA, 19 nt, Artificial Sequence
  Synthetic
uagcugauauugauggaca

SEQ ID NO: 945 - RNA, 19 nt, Artificial Sequence
  Synthetic
gaacugucuuuggacucuc

SEQ ID NO: 946 - RNA, 19 nt, Artificial Sequence
  Synthetic
uuagucacuggcagcaaca

SEQ ID NO: 947 - RNA, 19 nt, Artificial Sequence
  Synthetic
ccauuacaacucuccacaa

SEQ ID NO: 948 - RNA, 19 nt, Artificial Sequence
  Synthetic
gugguuaagcucuuacacc

SEQ ID NO: 949 - RNA, 19 nt, Artificial Sequence
  Synthetic
ugauuugauggaguuggac

SEQ ID NO: 950 - RNA, 19 nt, Artificial Sequence
  Synthetic
gcagagauggcccagaaug

SEQ ID NO: 951 - RNA, 19 nt, Artificial Sequence
  Synthetic
acuaaacaggaagggaugg

SEQ ID NO: 952 - RNA, 19 nt, Artificial Sequence
  Synthetic
acaaauguuaaauucuugg

SEQ ID NO: 953 - RNA, 19 nt, Artificial Sequence
  Synthetic
gcaaugacucgagcucaga

SEQ ID NO: 954 - RNA, 19 nt, Artificial Sequence
  Synthetic
cucgggauguucacaaccg

SEQ ID NO: 955 - RNA, 19 nt, Artificial Sequence
  Synthetic
gugucugcuauuguacgua

SEQ ID NO: 956 - RNA, 19 nt, Artificial Sequence
  Synthetic
uguggauaccucccaaguc

SEQ ID NO: 957 - RNA, 19 nt, Artificial Sequence
  Synthetic
ggaugccuuggguauggac

SEQ ID NO: 958 - RNA, 19 nt, Artificial Sequence
  Synthetic
aaauucuuggcuauuacga

SEQ ID NO: 959 - RNA, 19 nt, Artificial Sequence
  Synthetic
uacgagcugcuauguuccc

SEQ ID NO: 960 - RNA, 19 nt, Artificial Sequence
  Synthetic
cagugcguuuagcuggugg

SEQ ID NO: 961 - RNA, 19 nt, Artificial Sequence
  Synthetic
caagaugaugcagaacuug

SEQ ID NO: 962 - RNA, 19 nt, Artificial Sequence
  Synthetic
augauguagaaacagcucg

SEQ ID NO: 963 - RNA, 19 nt, Artificial Sequence
  Synthetic
ugcagcugcuuuauucucc

SEQ ID NO: 964 - RNA, 19 nt, Artificial Sequence
  Synthetic
ccacagcuccuucucugag

SEQ ID NO: 965 - RNA, 19 nt, Artificial Sequence
  Synthetic
caguucgccuucacuaugg

SEQ ID NO: 966 - RNA, 19 nt, Artificial Sequence
  Synthetic
aagcuuccagacacgcuau

SEQ ID NO: 967 - RNA, 19 nt, Artificial Sequence
  Synthetic
uuucaguugagcugaccag

SEQ ID NO: 968 - RNA, 19 nt, Artificial Sequence
  Synthetic
ucuggugccacuaccacag

SEQ ID NO: 969 - RNA, 19 nt, Artificial Sequence
  Synthetic
cgcuaucaugcguucuccu

SEQ ID NO: 970 - RNA, 19 nt, Artificial Sequence
  Synthetic
gacagggaagacaucacug

SEQ ID NO: 971 - RNA, 19 nt, Artificial Sequence
  Synthetic
aucauacuggcuaguggug

SEQ ID NO: 972 - RNA, 19 nt, Artificial Sequence
  Synthetic
gcuggugacagggaagaca

SEQ ID NO: 973 - RNA, 19 nt, Artificial Sequence
  Synthetic
auccuagcucgggauguuc

SEQ ID NO: 974 - RNA, 19 nt, Artificial Sequence
  Synthetic
guccuguaugagugggaac

SEQ ID NO: 975 - RNA, 19 nt, Artificial Sequence
  Synthetic
ugggauauguauggguagg

SEQ ID NO: 976 - RNA, 19 nt, Artificial Sequence
  Synthetic
cuuggacuugauauuggug

SEQ ID NO: 977 - RNA, 19 nt, Artificial Sequence
  Synthetic
ccuuugucccgcaaaucau

SEQ ID NO: 978 - RNA, 19 nt, Artificial Sequence
  Synthetic
ugaaggugcuaucugucug

SEQ ID NO: 979 - RNA, 19 nt, Artificial Sequence
  Synthetic
ccuucacucaagaacaagu

SEQ ID NO: 980 - RNA, 19 nt, Artificial Sequence
  Synthetic
gaaggucuccuugggacuc

SEQ ID NO: 981 - RNA, 19 nt, Artificial Sequence
  Synthetic
agaaacggcuuucaguuga

SEQ ID NO: 982 - RNA, 19 nt, Artificial Sequence
  Synthetic
acccagcgccguacgucca

SEQ ID NO: 983 - RNA, 19 nt, Artificial Sequence
  Synthetic
cauaaccuuucccaucauc

SEQ ID NO: 984 - RNA, 19 nt, Artificial Sequence
  Synthetic
gaagguuguaccggagccc

SEQ ID NO: 985 - RNA, 19 nt, Artificial Sequence
  Synthetic
gucccgcaaaucaugcacc

SEQ ID NO: 986 - RNA, 19 nt, Artificial Sequence
  Synthetic
caagcucaucauacuggcu

SEQ ID NO: 987 - RNA, 19 nt, Artificial Sequence
  Synthetic
cgccguacguccaugggug

SEQ ID NO: 988 - RNA, 19 nt, Artificial Sequence
  Synthetic
agaguuacuucacucuagg

SEQ ID NO: 989 - RNA, 19 nt, Artificial Sequence
  Synthetic
guuggacauggccauggaa

SEQ ID NO: 990 - RNA, 19 nt, Artificial Sequence
  Synthetic
uggcuauuacgacagacug

SEQ ID NO: 991 - RNA, 19 nt, Artificial Sequence
  Synthetic
acucgagcucagaggguac

SEQ ID NO: 992 - RNA, 19 nt, Artificial Sequence
  Synthetic
acaguuugaugcugcucau

SEQ ID NO: 993 - RNA, 19 nt, Artificial Sequence
  Synthetic
ggugguuaauaaggcugca

SEQ ID NO: 994 - RNA, 19 nt, Artificial Sequence
  Synthetic
cuuugucccgcaaaucaug

SEQ ID NO: 995 - RNA, 19 nt, Artificial Sequence
  Synthetic
aauaccauuccauuguuug

SEQ ID NO: 996 - RNA, 19 nt, Artificial Sequence
  Synthetic
ccacacgugcaaucccuga

SEQ ID NO: 997 - RNA, 19 nt, Artificial Sequence
  Synthetic
auggccaggaugccuuggg

SEQ ID NO: 998 - RNA, 19 nt, Artificial Sequence
  Synthetic
ggauacccagcgccguacg

SEQ ID NO: 999 - RNA, 19 nt, Artificial Sequence
  Synthetic
ucgccaggaugauccuagc

SEQ ID NO: 1000 - RNA, 19 nt, Artificial Sequence
  Synthetic
ugguccaucagcuuucuaa

SEQ ID NO: 1001 - RNA, 19 nt, Artificial Sequence
  Synthetic
auauguauggguaggguaa

SEQ ID NO: 1002 - RNA, 19 nt, Artificial Sequence
  Synthetic
cccagaaugcaguucgccu

SEQ ID NO: 1003 - RNA, 19 nt, Artificial Sequence
  Synthetic
uauuguagaagcuggugga

SEQ ID NO: 1004 - RNA, 19 nt, Artificial Sequence
  Synthetic
guauggguaggguaaauca

SEQ ID NO: 1005 - RNA, 19 nt, Artificial Sequence
  Synthetic
gaucuuggacuugauauug

SEQ ID NO: 1006 - RNA, 19 nt, Artificial Sequence
  Synthetic
acacgugcaaucccugaac

SEQ ID NO: 1007 - RNA, 19 nt, Artificial Sequence
  Synthetic
agcgccguacguccauggg

SEQ ID NO: 1008 - RNA, 19 nt, Artificial Sequence
  Synthetic
uguaccggagcccuucaca

SEQ ID NO: 1009 - RNA, 19 nt, Artificial Sequence
  Synthetic
guugaugggcugccagauc

SEQ ID NO: 1010 - RNA, 19 nt, Artificial Sequence
  Synthetic
acacccaccaucccacugg

SEQ ID NO: 1011 - RNA, 19 nt, Artificial Sequence
  Synthetic
uacgacagacugccuucaa

SEQ ID NO: 1012 - RNA, 19 nt, Artificial Sequence
  Synthetic
uuguucgugcacaucagga

SEQ ID NO: 1013 - RNA, 19 nt, Artificial Sequence
  Synthetic
caaaucaugcaccuuugcg

SEQ ID NO: 1014 - RNA, 19 nt, Artificial Sequence
  Synthetic
gucuggaggcauuccugcc

SEQ ID NO: 1015 - RNA, 19 nt, Artificial Sequence
  Synthetic
cacuauggacuaccaguug

SEQ ID NO: 1016 - RNA, 19 nt, Artificial Sequence
  Synthetic
uaucaugcguucuccucag

SEQ ID NO: 1017 - RNA, 19 nt, Artificial Sequence
  Synthetic
guagaaacagcucguugua

SEQ ID NO: 1018 - RNA, 19 nt, Artificial Sequence
  Synthetic
cuccucugacagaguuacu

SEQ ID NO: 1019 - RNA, 19 nt, Artificial Sequence
  Synthetic
ugcucaggacaaggaagcu

SEQ ID NO: 1020 - RNA, 19 nt, Artificial Sequence
  Synthetic
caagugggugguauagagg

SEQ ID NO: 1021 - RNA, 19 nt, Artificial Sequence
  Synthetic
uggugguuaauaaggcugc

SEQ ID NO: 1022 - RNA, 19 nt, Artificial Sequence
  Synthetic
acuucaccugacagaucca

SEQ ID NO: 1023 - RNA, 19 nt, Artificial Sequence
  Synthetic
cgccuucacuauggacuac

SEQ ID NO: 1024 - RNA, 19 nt, Artificial Sequence
  Synthetic
ugcguucuccucagauggu

SEQ ID NO: 1025 - RNA, 19 nt, Artificial Sequence
  Synthetic
guuguaccggagcccuuca

SEQ ID NO: 1026 - RNA, 19 nt, Artificial Sequence
  Synthetic
cgacaccaagaagcagaga

SEQ ID NO: 1027 - RNA, 19 nt, Artificial Sequence
  Synthetic
ucaccaguggauucugugu

SEQ ID NO: 1028 - RNA, 19 nt, Artificial Sequence
  Synthetic
ggugacagggaagacauca

SEQ ID NO: 1029 - RNA, 19 nt, Artificial Sequence
  Synthetic
ucuaguaauaagccggcua

SEQ ID NO: 1030 - RNA, 19 nt, Artificial Sequence
  Synthetic
gugguuaauaaggcugcag

SEQ ID NO: 1031 - RNA, 19 nt, Artificial Sequence
  Synthetic
uccucagauggugucugcu

SEQ ID NO: 1032 - RNA, 19 nt, Artificial Sequence
  Synthetic
auggacaguaugcaaugac

SEQ ID NO: 1033 - RNA, 19 nt, Artificial Sequence
  Synthetic
ugcgugagcagggugccau

SEQ ID NO: 1034 - RNA, 19 nt, Artificial Sequence
  Synthetic
acucuaggaaugaaggugu

SEQ ID NO: 1035 - RNA, 19 nt, Artificial Sequence
  Synthetic
gacauuagaugagggcaug

SEQ ID NO: 1036 - RNA, 19 nt, Artificial Sequence
  Synthetic
cuggugacagggaagacau

SEQ ID NO: 1037 - RNA, 19 nt, Artificial Sequence
  Synthetic
ugauucgaaaucuugcccu

SEQ ID NO: 1038 - RNA, 19 nt, Artificial Sequence
  Synthetic
gcucuuacacccaccaucc

SEQ ID NO: 1039 - RNA, 19 nt, Artificial Sequence
  Synthetic
guccuucgggcuggugaca

SEQ ID NO: 1040 - RNA, 19 nt, Artificial Sequence
  Synthetic
gugcguacuguccuucggg

SEQ ID NO: 1041 - RNA, 19 nt, Artificial Sequence
  Synthetic
uggugcugacuauccaguu

SEQ ID NO: 1042 - RNA, 19 nt, Artificial Sequence
  Synthetic
gcuauugaagcugagggag

SEQ ID NO: 1043 - RNA, 19 nt, Artificial Sequence
  Synthetic
caaccaagaaagcaagcuc

SEQ ID NO: 1044 - RNA, 19 nt, Artificial Sequence
  Synthetic
gugcagcugcuuuauucuc

SEQ ID NO: 1045 - RNA, 19 nt, Artificial Sequence
  Synthetic
cuaucugucugcucuagua

SEQ ID NO: 1046 - RNA, 19 nt, Artificial Sequence
  Synthetic
aaacaggaagggauggaag

SEQ ID NO: 1047 - RNA, 19 nt, Artificial Sequence
  Synthetic
acuggcuagugguggaccc

SEQ ID NO: 1048 - RNA, 19 nt, Artificial Sequence
  Synthetic
ccucugugaacuugcucag

SEQ ID NO: 1049 - RNA, 19 nt, Artificial Sequence
  Synthetic
uguagaaacagcucguugu

SEQ ID NO: 1050 - RNA, 19 nt, Artificial Sequence
  Synthetic
cugacagauccaagucaac

SEQ ID NO: 1051 - RNA, 19 nt, Artificial Sequence
  Synthetic
ggaagaggauguggauacc

SEQ ID NO: 1052 - RNA, 19 nt, Artificial Sequence
  Synthetic
accaucacagaugcugaaa

SEQ ID NO: 1053 - RNA, 19 nt, Artificial Sequence
  Synthetic
ccguacguccauggguggg

SEQ ID NO: 1054 - RNA, 19 nt, Artificial Sequence
  Synthetic
cauuccauuguuugugcag

SEQ ID NO: 1055 - RNA, 19 nt, Artificial Sequence
  Synthetic
cuccaggugacagcaauca

SEQ ID NO: 1056 - RNA, 19 nt, Artificial Sequence
  Synthetic
cuaccaguugugguuaagc

SEQ ID NO: 1057 - RNA, 19 nt, Artificial Sequence
  Synthetic
uugugguuaagcucuuaca

SEQ ID NO: 1058 - RNA, 19 nt, Artificial Sequence
  Synthetic
uaguaauaagccggcuauu

SEQ ID NO: 1059 - RNA, 19 nt, Artificial Sequence
  Synthetic
caguccuucacucaagaac

SEQ ID NO: 1060 - RNA, 19 nt, Artificial Sequence
  Synthetic
agcugauuugauggaguug

SEQ ID NO: 1061 - RNA, 19 nt, Artificial Sequence
  Synthetic
aggucuccuugggacucuu

SEQ ID NO: 1062 - RNA, 19 nt, Artificial Sequence
  Synthetic
acuauggacuaccaguugu

SEQ ID NO: 1063 - RNA, 19 nt, Artificial Sequence
  Synthetic
cagcagcaauuuguggagg

SEQ ID NO: 1064 - RNA, 19 nt, Artificial Sequence
  Synthetic
cgugcacaucaggauaccc

SEQ ID NO: 1065 - RNA, 19 nt, Artificial Sequence
  Synthetic
cguucuccucagauggugu

SEQ ID NO: 1066 - RNA, 19 nt, Artificial Sequence
  Synthetic
caguaugcaaugacucgag

SEQ ID NO: 1067 - RNA, 19 nt, Artificial Sequence
  Synthetic
gguauagaggcucuugugc

SEQ ID NO: 1068 - RNA, 19 nt, Artificial Sequence
  Synthetic
auccaguugaugggcugcc

SEQ ID NO: 1069 - RNA, 19 nt, Artificial Sequence
  Synthetic
ugccaagugggugguauag

SEQ ID NO: 1070 - RNA, 19 nt, Artificial Sequence
  Synthetic
acaucaggauacccagcgc

SEQ ID NO: 1071 - RNA, 19 nt, Artificial Sequence
  Synthetic
gccaucuuuaagucuggag

SEQ ID NO: 1072 - RNA, 19 nt, Artificial Sequence
  Synthetic
aaccuuucccaucaucgug

SEQ ID NO: 1073 - RNA, 19 nt, Artificial Sequence
  Synthetic
cuaguucaguugcuuguuc

SEQ ID NO: 1074 - RNA, 19 nt, Artificial Sequence
  Synthetic
uucacucaagaacaaguag

SEQ ID NO: 1075 - RNA, 19 nt, Artificial Sequence
  Synthetic
aagaagcagagauggccca

SEQ ID NO: 1076 - RNA, 19 nt, Artificial Sequence
  Synthetic
uccucugacagaguuacuu

SEQ ID NO: 1077 - RNA, 19 nt, Artificial Sequence
  Synthetic
aauuguuaucagaggacua

SEQ ID NO: 1078 - RNA, 19 nt, Artificial Sequence
  Synthetic
ucucaguccuucacucaag

SEQ ID NO: 1079 - RNA, 19 nt, Artificial Sequence
  Synthetic
uccagacacgcuaucaugc

SEQ ID NO: 1080 - RNA, 19 nt, Artificial Sequence
  Synthetic
cacuaauguccagcguuug

SEQ ID NO: 1081 - RNA, 19 nt, Artificial Sequence
  Synthetic
uuguaaccugcugugauac

SEQ ID NO: 1082 - RNA, 19 nt, Artificial Sequence
  Synthetic
cuucuggguucagaugaua

SEQ ID NO: 1083 - RNA, 19 nt, Artificial Sequence
  Synthetic
gccguacguccaugggugg

SEQ ID NO: 1084 - RNA, 19 nt, Artificial Sequence
  Synthetic
uaguugaagguuguaccgg

SEQ ID NO: 1085 - RNA, 19 nt, Artificial Sequence
  Synthetic
gaggacaagccacaagauu

SEQ ID NO: 1086 - RNA, 19 nt, Artificial Sequence
  Synthetic
gggagccacagcuccucug

SEQ ID NO: 1087 - RNA, 19 nt, Artificial Sequence
  Synthetic
cuucaccugacagauccaa

SEQ ID NO: 1088 - RNA, 19 nt, Artificial Sequence
  Synthetic
ucuuucagaugcugcaacu

SEQ ID NO: 1089 - RNA, 19 nt, Artificial Sequence
  Synthetic
uguaaccugcugugauacg

SEQ ID NO: 1090 - RNA, 19 nt, Artificial Sequence
  Synthetic
ccucccaaguccuguauga

SEQ ID NO: 1091 - RNA, 19 nt, Artificial Sequence
  Synthetic
ggcagugcguuuagcuggu

SEQ ID NO: 1092 - RNA, 19 nt, Artificial Sequence
  Synthetic
cucuaguaauaagccggcu

SEQ ID NO: 1093 - RNA, 19 nt, Artificial Sequence
  Synthetic
gcuguuagucacuggcagc

SEQ ID NO: 1094 - RNA, 19 nt, Artificial Sequence
  Synthetic
gucaacgucuuguucagaa

SEQ ID NO: 1095 - RNA, 19 nt, Artificial Sequence
  Synthetic
gaagaggauguggauaccu

SEQ ID NO: 1096 - RNA, 19 nt, Artificial Sequence
  Synthetic
uaaccugcugugauacgau

SEQ ID NO: 1097 - RNA, 19 nt, Artificial Sequence
  Synthetic
guuauuuggaaccuuguuu

SEQ ID NO: 1098 - RNA, 19 nt, Artificial Sequence
  Synthetic
ucacaaccgaauuguuauc

SEQ ID NO: 1099 - RNA, 19 nt, Artificial Sequence
  Synthetic
cgggcuggugacagggaag

SEQ ID NO: 1100 - RNA, 19 nt, Artificial Sequence
  Synthetic
acaaccgaauuguuaucag

SEQ ID NO: 1101 - RNA, 19 nt, Artificial Sequence
  Synthetic
ccacuaauguccagcguuu

SEQ ID NO: 1102 - RNA, 19 nt, Artificial Sequence
  Synthetic
cacugagccugccaucugu

SEQ ID NO: 1103 - RNA, 19 nt, Artificial Sequence
  Synthetic
gguccaucagcuuucuaaa

SEQ ID NO: 1104 - RNA, 19 nt, Artificial Sequence
  Synthetic
aucccaaaguuguuguaac

SEQ ID NO: 1105 - RNA, 19 nt, Artificial Sequence
  Synthetic
ugaggaccuauacuuacga

SEQ ID NO: 1106 - RNA, 19 nt, Artificial Sequence
  Synthetic
ugucugaggacaagccaca

SEQ ID NO: 1107 - RNA, 19 nt, Artificial Sequence
  Synthetic
aguugaugggcugccagau

SEQ ID NO: 1108 - RNA, 19 nt, Artificial Sequence
  Synthetic
ugaccagccgacaccaaga

SEQ ID NO: 1109 - RNA, 19 nt, Artificial Sequence
  Synthetic
agggagccacagcuccucu

SEQ ID NO: 1110 - RNA, 19 nt, Artificial Sequence
  Synthetic
aaaguuguuguaaccugcu

SEQ ID NO: 1111 - RNA, 19 nt, Artificial Sequence
  Synthetic
cugcaguuaugguccauca

SEQ ID NO: 1112 - RNA, 19 nt, Artificial Sequence
  Synthetic
ugaagguuguaccggagcc

SEQ ID NO: 1113 - RNA, 19 nt, Artificial Sequence
  Synthetic
uucccugagacauuagaug

SEQ ID NO: 1114 - RNA, 19 nt, Artificial Sequence
  Synthetic
cuucgggcuggugacaggg

SEQ ID NO: 1115 - RNA, 19 nt, Artificial Sequence
  Synthetic
uugagcugaccagcucucu

SEQ ID NO: 1116 - RNA, 19 nt, Artificial Sequence
  Synthetic
gaacuugcucaggacaagg

SEQ ID NO: 1117 - RNA, 19 nt, Artificial Sequence
  Synthetic
ccagccgacaccaagaagc

SEQ ID NO: 1118 - RNA, 19 nt, Artificial Sequence
  Synthetic
agggugccauuccacgacu

SEQ ID NO: 1119 - RNA, 19 nt, Artificial Sequence
  Synthetic
uugugcagcugcuuuauuc

SEQ ID NO: 1120 - RNA, 19 nt, Artificial Sequence
  Synthetic
ucacucaagaacaaguagc

SEQ ID NO: 1121 - RNA, 19 nt, Artificial Sequence
  Synthetic
gcugguggaaugcaagcuu

SEQ ID NO: 1122 - RNA, 19 nt, Artificial Sequence
  Synthetic
gcaacuaaacaggaaggga

SEQ ID NO: 1123 - RNA, 19 nt, Artificial Sequence
  Synthetic
agguuguaccggagcccuu

SEQ ID NO: 1124 - RNA, 19 nt, Artificial Sequence
  Synthetic
aggcugcaguuauggucca

SEQ ID NO: 1125 - RNA, 19 nt, Artificial Sequence
  Synthetic
gcagaucccaucuacacag

SEQ ID NO: 1126 - RNA, 19 nt, Artificial Sequence
  Synthetic
cuaggaaugaagguguggc

SEQ ID NO: 1127 - RNA, 19 nt, Artificial Sequence
  Synthetic
agcuccuucucugaguggu

SEQ ID NO: 1128 - RNA, 19 nt, Artificial Sequence
  Synthetic
uuacaacucuccacaaccu

SEQ ID NO: 1129 - RNA, 19 nt, Artificial Sequence
  Synthetic
gguaaaggcaauccugagg

SEQ ID NO: 1130 - RNA, 19 nt, Artificial Sequence
  Synthetic
guucgccuucacuauggac

SEQ ID NO: 1131 - RNA, 19 nt, Artificial Sequence
  Synthetic
caaauguuaaauucuuggc

SEQ ID NO: 1132 - RNA, 19 nt, Artificial Sequence
  Synthetic
cugugauacgaugcuucaa

SEQ ID NO: 1133 - RNA, 19 nt, Artificial Sequence
  Synthetic
acaaaugauguagaaacag

SEQ ID NO: 1134 - RNA, 19 nt, Artificial Sequence
  Synthetic
gguacgagcugcuauguuc

SEQ ID NO: 1135 - RNA, 19 nt, Artificial Sequence
  Synthetic
gaauuguuaucagaggacu

SEQ ID NO: 1136 - RNA, 19 nt, Artificial Sequence
  Synthetic
caaccgaauuguuaucaga

SEQ ID NO: 1137 - RNA, 19 nt, Artificial Sequence
  Synthetic
gugauacgaugcuucaaga

SEQ ID NO: 1138 - RNA, 19 nt, Artificial Sequence
  Synthetic
aaaggcaauccugaggaag

SEQ ID NO: 1139 - RNA, 19 nt, Artificial Sequence
  Synthetic
cagcuccucugacagaguu

SEQ ID NO: 1140 - RNA, 19 nt, Artificial Sequence
  Synthetic
auggucugccaagugggug

SEQ ID NO: 1141 - RNA, 19 nt, Artificial Sequence
  Synthetic
gcuacuguuggauugauuc

SEQ ID NO: 1142 - RNA, 19 nt, Artificial Sequence
  Synthetic
ugcaaugacucgagcucag

SEQ ID NO: 1143 - RNA, 19 nt, Artificial Sequence
  Synthetic
gacuugauauuggugccca

SEQ ID NO: 1144 - RNA, 19 nt, Artificial Sequence
  Synthetic
cagaacugucuuuggacuc

SEQ ID NO: 1145 - RNA, 19 nt, Artificial Sequence
  Synthetic
uaguucaguugcuuguucg

SEQ ID NO: 1146 - RNA, 19 nt, Artificial Sequence
  Synthetic
acagacugccuucaaauuu

SEQ ID NO: 1147 - RNA, 19 nt, Artificial Sequence
  Synthetic
gggugguauagaggcucuu

SEQ ID NO: 1148 - RNA, 19 nt, Artificial Sequence
  Synthetic
auggacuaccaguuguggu

SEQ ID NO: 1149 - RNA, 19 nt, Artificial Sequence
  Synthetic
auuguuaucagaggacuaa

SEQ ID NO: 1150 - RNA, 19 nt, Artificial Sequence
  Synthetic
uaaggcugcaguuaugguc

SEQ ID NO: 1151 - RNA, 19 nt, Artificial Sequence
  Synthetic
aaaucuugcccuuuguccc

SEQ ID NO: 1152 - RNA, 19 nt, Artificial Sequence
  Synthetic
agcagcaauuuguggaggg

SEQ ID NO: 1153 - RNA, 19 nt, Artificial Sequence
  Synthetic
agaggacuaaauaccauuc

SEQ ID NO: 1154 - RNA, 19 nt, Artificial Sequence
  Synthetic
gcugaaggugcuaucuguc

SEQ ID NO: 1155 - RNA, 19 nt, Artificial Sequence
  Synthetic
uguaugagugggaacaggg

SEQ ID NO: 1156 - RNA, 19 nt, Artificial Sequence
  Synthetic
cagaucccaucuacacagu

SEQ ID NO: 1157 - RNA, 19 nt, Artificial Sequence
  Synthetic
gacacagcagcaauuugug

SEQ ID NO: 1158 - RNA, 19 nt, Artificial Sequence
  Synthetic
gggcaugcagaucccaucu

SEQ ID NO: 1159 - RNA, 19 nt, Artificial Sequence
  Synthetic
caugcccaggaccucaugg

SEQ ID NO: 1160 - RNA, 19 nt, Artificial Sequence
  Synthetic
gaagcugagggagccacag

SEQ ID NO: 1161 - RNA, 19 nt, Artificial Sequence
  Synthetic
cuguuagucacuggcagca

SEQ ID NO: 1162 - RNA, 19 nt, Artificial Sequence
  Synthetic
cuuguucagcuucuggguu

SEQ ID NO: 1163 - RNA, 19 nt, Artificial Sequence
  Synthetic
aagcugguggaaugcaagc

SEQ ID NO: 1164 - RNA, 19 nt, Artificial Sequence
  Synthetic
gaggauguggauaccuccc

SEQ ID NO: 1165 - RNA, 19 nt, Artificial Sequence
  Synthetic
auaaauguggucaccugug

SEQ ID NO: 1166 - RNA, 19 nt, Artificial Sequence
  Synthetic
uacguccaugggugggaca

SEQ ID NO: 1167 - RNA, 19 nt, Artificial Sequence
  Synthetic
gauggaguuggacauggcc

SEQ ID NO: 1168 - RNA, 19 nt, Artificial Sequence
  Synthetic
uguccagcguuuggcugaa

SEQ ID NO: 1169 - RNA, 19 nt, Artificial Sequence
  Synthetic
gagcagggugccauuccac

SEQ ID NO: 1170 - RNA, 19 nt, Artificial Sequence
  Synthetic
aaauauaaugaggaccuau

SEQ ID NO: 1171 - RNA, 19 nt, Artificial Sequence
  Synthetic
uacuggcuagugguggacc

SEQ ID NO: 1172 - RNA, 19 nt, Artificial Sequence
  Synthetic
ugcuugguucaccagugga

SEQ ID NO: 1173 - RNA, 19 nt, Artificial Sequence
  Synthetic
cugaggacaagccacaaga

SEQ ID NO: 1174 - RNA, 19 nt, Artificial Sequence
  Synthetic
cuugugcguacuguccuuc

SEQ ID NO: 1175 - RNA, 19 nt, Artificial Sequence
  Synthetic
uguuauuuggaaccuuguu

SEQ ID NO: 1176 - RNA, 19 nt, Artificial Sequence
  Synthetic
uagcuuauggcaaccaaga

SEQ ID NO: 1177 - RNA, 19 nt, Artificial Sequence
  Synthetic
ugauacgaugcuucaagag

SEQ ID NO: 1178 - RNA, 19 nt, Artificial Sequence
  Synthetic
ugguauagaggcucuugug

SEQ ID NO: 1179 - RNA, 19 nt, Artificial Sequence
  Synthetic
gauguagaaacagcucguu

SEQ ID NO: 1180 - RNA, 19 nt, Artificial Sequence
  Synthetic
ccuuucccaucaucgugag

SEQ ID NO: 1181 - RNA, 19 nt, Artificial Sequence
  Synthetic
gcguucuccucagauggug

SEQ ID NO: 1182 - RNA, 19 nt, Artificial Sequence
  Synthetic
ucaggauacccagcgccgu

SEQ ID NO: 1183 - RNA, 19 nt, Artificial Sequence
  Synthetic
acggcuuucaguugagcug

SEQ ID NO: 1184 - RNA, 19 nt, Artificial Sequence
  Synthetic
guugaagguuguaccggag

SEQ ID NO: 1185 - RNA, 19 nt, Artificial Sequence
  Synthetic
uaucgccaggaugauccua

SEQ ID NO: 1186 - RNA, 19 nt, Artificial Sequence
  Synthetic
gugcugaaggugcuaucug

SEQ ID NO: 1187 - RNA, 19 nt, Artificial Sequence
  Synthetic
gucuuuggacucucaggaa

SEQ ID NO: 1188 - RNA, 19 nt, Artificial Sequence
  Synthetic
gggauggaaggucuccuug

SEQ ID NO: 1189 - RNA, 19 nt, Artificial Sequence
  Synthetic
ugagcugaccagcucucuc

SEQ ID NO: 1190 - RNA, 19 nt, Artificial Sequence
  Synthetic
cuuucccaucaucgugagg

SEQ ID NO: 1191 - RNA, 19 nt, Artificial Sequence
  Synthetic
aagcuuuaggacuucaccu

SEQ ID NO: 1192 - RNA, 19 nt, Artificial Sequence
  Synthetic
uggaaugcaagcuuuagga

SEQ ID NO: 1193 - RNA, 19 nt, Artificial Sequence
  Synthetic
cuggaggcauuccugcccu

SEQ ID NO: 1194 - RNA, 19 nt, Artificial Sequence
  Synthetic
aguucaguugcuuguucgu

SEQ ID NO: 1195 - RNA, 19 nt, Artificial Sequence
  Synthetic
gagcugcuauguucccuga

SEQ ID NO: 1196 - RNA, 19 nt, Artificial Sequence
  Synthetic
ggccaggaugccuugggua

SEQ ID NO: 1197 - RNA, 19 nt, Artificial Sequence
  Synthetic
gaugauccuagcuaucguu

SEQ ID NO: 1198 - RNA, 19 nt, Artificial Sequence
  Synthetic
gauugauucgaaaucuugc

SEQ ID NO: 1199 - RNA, 19 nt, Artificial Sequence
  Synthetic
cagagauggcccagaaugc

SEQ ID NO: 1200 - RNA, 19 nt, Artificial Sequence
  Synthetic
cagcgccguacguccaugg

SEQ ID NO: 1201 - RNA, 19 nt, Artificial Sequence
  Synthetic
auguagaaacagcucguug

SEQ ID NO: 1202 - RNA, 19 nt, Artificial Sequence
  Synthetic
agugcugaaggugcuaucu

SEQ ID NO: 1203 - RNA, 19 nt, Artificial Sequence
  Synthetic
gacuaccaguugugguuaa

SEQ ID NO: 1204 - RNA, 19 nt, Artificial Sequence
  Synthetic
acaggaagggauggaaggu

SEQ ID NO: 1205 - RNA, 19 nt, Artificial Sequence
  Synthetic
cagguggugguuaauaagg

SEQ ID NO: 1206 - RNA, 19 nt, Artificial Sequence
  Synthetic
aaggcugcaguuauggucc

SEQ ID NO: 1207 - RNA, 19 nt, Artificial Sequence
  Synthetic
uaaauguggucaccugugc

SEQ ID NO: 1208 - RNA, 19 nt, Artificial Sequence
  Synthetic
uaaaggcuacuguuggauu

SEQ ID NO: 1209 - RNA, 19 nt, Artificial Sequence
  Synthetic
gauggacaguaugcaauga

SEQ ID NO: 1210 - RNA, 19 nt, Artificial Sequence
  Synthetic
uucuggguucagaugauau

SEQ ID NO: 1211 - RNA, 19 nt, Artificial Sequence
  Synthetic
guacuguccuucgggcugg

SEQ ID NO: 1212 - RNA, 19 nt, Artificial Sequence
  Synthetic
cuugguucaccaguggauu

SEQ ID NO: 1213 - RNA, 19 nt, Artificial Sequence
  Synthetic
uauugaagcugagggagcc

SEQ ID NO: 1214 - RNA, 19 nt, Artificial Sequence
  Synthetic
guuguuguaaccugcugug

SEQ ID NO: 1215 - RNA, 19 nt, Artificial Sequence
  Synthetic
agcagggugccauuccacg

SEQ ID NO: 1216 - RNA, 19 nt, Artificial Sequence
  Synthetic
guccucugugaacuugcuc

SEQ ID NO: 1217 - RNA, 19 nt, Artificial Sequence
  Synthetic
ucugaccagccgacaccaa

SEQ ID NO: 1218 - RNA, 19 nt, Artificial Sequence
  Synthetic
gccauggaaccagacagaa

SEQ ID NO: 1219 - RNA, 19 nt, Artificial Sequence
  Synthetic
aagcuauugaagcugaggg

SEQ ID NO: 1220 - RNA, 19 nt, Artificial Sequence
  Synthetic
gauucgaaaucuugcccuu

SEQ ID NO: 1221 - RNA, 19 nt, Artificial Sequence
  Synthetic
aguugcuuguucgugcaca

SEQ ID NO: 1222 - RNA, 19 nt, Artificial Sequence
  Synthetic
aagaacaagaugauggucu

SEQ ID NO: 1223 - RNA, 19 nt, Artificial Sequence
  Synthetic
agugguaaaggcaauccug

SEQ ID NO: 1224 - RNA, 19 nt, Artificial Sequence
  Synthetic
cagaugcugcaacuaaaca

SEQ ID NO: 1225 - RNA, 19 nt, Artificial Sequence
  Synthetic
ccugagacauuagaugagg

SEQ ID NO: 1226 - RNA, 19 nt, Artificial Sequence
  Synthetic
ucccaaaguuguuguaacc

SEQ ID NO: 1227 - RNA, 19 nt, Artificial Sequence
  Synthetic
cugaccagccgacaccaag

SEQ ID NO: 1228 - RNA, 19 nt, Artificial Sequence
  Synthetic
auccaaagaguagcugcag

SEQ ID NO: 1229 - RNA, 19 nt, Artificial Sequence
  Synthetic
auguccagcguuuggcuga

SEQ ID NO: 1230 - RNA, 19 nt, Artificial Sequence
  Synthetic
ucuugugcguacuguccuu

SEQ ID NO: 1231 - RNA, 19 nt, Artificial Sequence
  Synthetic
aggauguggauaccuccca

SEQ ID NO: 1232 - RNA, 19 nt, Artificial Sequence
  Synthetic
ggcugcaguuaugguccau

SEQ ID NO: 1233 - RNA, 19 nt, Artificial Sequence
  Synthetic
ucacauccuagcucgggau

SEQ ID NO: 1234 - RNA, 19 nt, Artificial Sequence
  Synthetic
accaagaagcagagauggc

SEQ ID NO: 1235 - RNA, 19 nt, Artificial Sequence
  Synthetic
gccaccacccuggugcuga

SEQ ID NO: 1236 - RNA, 19 nt, Artificial Sequence
  Synthetic
cccacuaauguccagcguu

SEQ ID NO: 1237 - RNA, 19 nt, Artificial Sequence
  Synthetic
acuggcagcaacagucuua

SEQ ID NO: 1238 - RNA, 19 nt, Artificial Sequence
  Synthetic
aucugaauaaaguguaaca

SEQ ID NO: 1239 - RNA, 19 nt, Artificial Sequence
  Synthetic
gccugccaucugugcucuu

SEQ ID NO: 1240 - RNA, 19 nt, Artificial Sequence
  Synthetic
cauuacaacucuccacaac

SEQ ID NO: 1241 - RNA, 19 nt, Artificial Sequence
  Synthetic
cuccucagauggugucugc

SEQ ID NO: 1242 - RNA, 19 nt, Artificial Sequence
  Synthetic
caguugcuuguucgugcac

SEQ ID NO: 1243 - RNA, 19 nt, Artificial Sequence
  Synthetic
auccugaggaagaggaugu

SEQ ID NO: 1244 - RNA, 19 nt, Artificial Sequence
  Synthetic
caccaguggauucuguguu

SEQ ID NO: 1245 - RNA, 19 nt, Artificial Sequence
  Synthetic
caagaaagcaagcucauca

SEQ ID NO: 1246 - RNA, 19 nt, Artificial Sequence
  Synthetic
cuugcauaaccuuucccau

SEQ ID NO: 1247 - RNA, 19 nt, Artificial Sequence
  Synthetic
cuucacuauggacuaccag

SEQ ID NO: 1248 - RNA, 19 nt, Artificial Sequence
  Synthetic
uugcuuguucgugcacauc

SEQ ID NO: 1249 - RNA, 19 nt, Artificial Sequence
  Synthetic
uauuguacguaccaugcag

SEQ ID NO: 1250 - RNA, 19 nt, Artificial Sequence
  Synthetic
gaaaucuugcccuuugucc

SEQ ID NO: 1251 - RNA, 19 nt, Artificial Sequence
  Synthetic
cucuugugcguacuguccu

SEQ ID NO: 1252 - RNA, 19 nt, Artificial Sequence
  Synthetic
cacaaccgaauuguuauca

SEQ ID NO: 1253 - RNA, 19 nt, Artificial Sequence
  Synthetic
gcuccucugacagaguuac

SEQ ID NO: 1254 - RNA, 19 nt, Artificial Sequence
  Synthetic
agcguuuggcugaaccauc

SEQ ID NO: 1255 - RNA, 19 nt, Artificial Sequence
  Synthetic
aaacggcuuucaguugagc

SEQ ID NO: 1256 - RNA, 19 nt, Artificial Sequence
  Synthetic
uuugucccgcaaaucaugc

SEQ ID NO: 1257 - RNA, 19 nt, Artificial Sequence
  Synthetic
ucuaggaaugaaggugugg

SEQ ID NO: 1258 - RNA, 19 nt, Artificial Sequence
  Synthetic
aaguccuguaugaguggga

SEQ ID NO: 1259 - RNA, 19 nt, Artificial Sequence
  Synthetic
gguucaccaguggauucug

SEQ ID NO: 1260 - RNA, 19 nt, Artificial Sequence
  Synthetic
ggucugccaaguggguggu

SEQ ID NO: 1261 - RNA, 19 nt, Artificial Sequence
  Synthetic
agcuccucugacagaguua

SEQ ID NO: 1262 - RNA, 19 nt, Artificial Sequence
  Synthetic
uucuggugccacuaccaca

SEQ ID NO: 1263 - RNA, 19 nt, Artificial Sequence
  Synthetic
ugcuauguucccugagaca

SEQ ID NO: 1264 - RNA, 19 nt, Artificial Sequence
  Synthetic
auugauucgaaaucuugcc

SEQ ID NO: 1265 - RNA, 19 nt, Artificial Sequence
  Synthetic
cucauggaugggcugccuc

SEQ ID NO: 1266 - RNA, 19 nt, Artificial Sequence
  Synthetic
gcugcuuuauucucccauu

SEQ ID NO: 1267 - RNA, 19 nt, Artificial Sequence
  Synthetic
aucaugcaccuuugcguga

SEQ ID NO: 1268 - RNA, 19 nt, Artificial Sequence
  Synthetic
gucacuggcagcaacaguc

SEQ ID NO: 1269 - RNA, 19 nt, Artificial Sequence
  Synthetic
ugagugggaacagggauuu

SEQ ID NO: 1270 - RNA, 19 nt, Artificial Sequence
  Synthetic
aauuauaagaacaagauga

SEQ ID NO: 1271 - RNA, 19 nt, Artificial Sequence
  Synthetic
uggacaguuuaccaguugc

SEQ ID NO: 1272 - RNA, 19 nt, Artificial Sequence
  Synthetic
augaggaccuauacuuacg

SEQ ID NO: 1273 - RNA, 19 nt, Artificial Sequence
  Synthetic
ggaaggucuccuugggacu

SEQ ID NO: 1274 - RNA, 19 nt, Artificial Sequence
  Synthetic
uggaagaaauaguugaagg

SEQ ID NO: 1275 - RNA, 19 nt, Artificial Sequence
  Synthetic
gguguuauuuggaaccuug

SEQ ID NO: 1276 - RNA, 19 nt, Artificial Sequence
  Synthetic
gugcucuucgucaucugac

SEQ ID NO: 1277 - RNA, 19 nt, Artificial Sequence
  Synthetic
ggccauggaaccagacaga

SEQ ID NO: 1278 - RNA, 19 nt, Artificial Sequence
  Synthetic
cggcuguuagucacuggca

SEQ ID NO: 1279 - RNA, 19 nt, Artificial Sequence
  Synthetic
uuccacgacuaguucaguu

SEQ ID NO: 1280 - RNA, 19 nt, Artificial Sequence
  Synthetic
agcagagauggcccagaau

SEQ ID NO: 1281 - RNA, 19 nt, Artificial Sequence
  Synthetic
gccaggaugauccuagcua

SEQ ID NO: 1282 - RNA, 19 nt, Artificial Sequence
  Synthetic
gccaucugugcucuucguc

SEQ ID NO: 1283 - RNA, 19 nt, Artificial Sequence
  Synthetic
uagaaacagcucguuguac

SEQ ID NO: 1284 - RNA, 19 nt, Artificial Sequence
  Synthetic
agaugauggucugccaagu

SEQ ID NO: 1285 - RNA, 19 nt, Artificial Sequence
  Synthetic
accuuucccaucaucguga

SEQ ID NO: 1286 - RNA, 19 nt, Artificial Sequence
  Synthetic
auggaguuggacauggcca

SEQ ID NO: 1287 - RNA, 19 nt, Artificial Sequence
  Synthetic
cugugcucuucgucaucug

SEQ ID NO: 1288 - RNA, 19 nt, Artificial Sequence
  Synthetic
uauaagaacaagaugaugg

SEQ ID NO: 1289 - RNA, 19 nt, Artificial Sequence
  Synthetic
ucugaauaaaguguaacaa

SEQ ID NO: 1290 - RNA, 19 nt, Artificial Sequence
  Synthetic
ccagaaugcaguucgccuu

SEQ ID NO: 1291 - RNA, 19 nt, Artificial Sequence
  Synthetic
agaacaagaugauggucug

SEQ ID NO: 1292 - RNA, 19 nt, Artificial Sequence
  Synthetic
aucuugcccuuugucccgc

SEQ ID NO: 1293 - RNA, 19 nt, Artificial Sequence
  Synthetic
gcguuuagcuggugggcug

SEQ ID NO: 1294 - RNA, 19 nt, Artificial Sequence
  Synthetic
ggguucagaugauauaaau

SEQ ID NO: 1295 - RNA, 19 nt, Artificial Sequence
  Synthetic
uuuaggacuucaccugaca

SEQ ID NO: 1296 - RNA, 19 nt, Artificial Sequence
  Synthetic
cacagcuccuucucugagu

SEQ ID NO: 1297 - RNA, 19 nt, Artificial Sequence
  Synthetic
aacgucuuguucagaacug

SEQ ID NO: 1298 - RNA, 19 nt, Artificial Sequence
  Synthetic
cacagcagcaauuugugga

SEQ ID NO: 1299 - RNA, 19 nt, Artificial Sequence
  Synthetic
gacuaguucaguugcuugu

SEQ ID NO: 1300 - RNA, 19 nt, Artificial Sequence
  Synthetic
gacagacugccuucaaauu

SEQ ID NO: 1301 - RNA, 19 nt, Artificial Sequence
  Synthetic
cucucucuucagaacagag

SEQ ID NO: 1302 - RNA, 19 nt, Artificial Sequence
  Synthetic
guccagcguuuggcugaac

SEQ ID NO: 1303 - RNA, 19 nt, Artificial Sequence
  Synthetic
uaagaacaagaugaugguc

SEQ ID NO: 1304 - RNA, 19 nt, Artificial Sequence
  Synthetic
uccaagucaacgucuuguu

SEQ ID NO: 1305 - RNA, 19 nt, Artificial Sequence
  Synthetic
acaccaagaagcagagaug

SEQ ID NO: 1306 - RNA, 19 nt, Artificial Sequence
  Synthetic
cucaggaaucuuucagaug

SEQ ID NO: 1307 - RNA, 19 nt, Artificial Sequence
  Synthetic
uaaauucuuggcuauuacg

SEQ ID NO: 1308 - RNA, 19 nt, Artificial Sequence
  Synthetic
cuauggacuaccaguugug

SEQ ID NO: 1309 - RNA, 19 nt, Artificial Sequence
  Synthetic
ccagcguuuggcugaacca

SEQ ID NO: 1310 - RNA, 19 nt, Artificial Sequence
  Synthetic
ucccaucaucgugagggcu

SEQ ID NO: 1311 - RNA, 19 nt, Artificial Sequence
  Synthetic
aggacuucaccugacagau

SEQ ID NO: 1312 - RNA, 19 nt, Artificial Sequence
  Synthetic
uugugcguacuguccuucg

SEQ ID NO: 1313 - RNA, 19 nt, Artificial Sequence
  Synthetic
ccaugggugggacacagca

SEQ ID NO: 1314 - RNA, 19 nt, Artificial Sequence
  Synthetic
ggauggaaggucuccuugg

SEQ ID NO: 1315 - RNA, 19 nt, Artificial Sequence
  Synthetic
cccagcgccguacguccau

SEQ ID NO: 1316 - RNA, 19 nt, Artificial Sequence
  Synthetic
gcucagaggguacgagcug

SEQ ID NO: 1317 - RNA, 19 nt, Artificial Sequence
  Synthetic
auguucacaaccgaauugu

SEQ ID NO: 1318 - RNA, 19 nt, Artificial Sequence
  Synthetic
ugcuuguucgugcacauca

SEQ ID NO: 1319 - RNA, 19 nt, Artificial Sequence
  Synthetic
auguucccugagacauuag

SEQ ID NO: 1320 - RNA, 19 nt, Artificial Sequence
  Synthetic
guaaaggcaauccugagga

SEQ ID NO: 1321 - RNA, 19 nt, Artificial Sequence
  Synthetic
cacuggcagcaacagucuu

SEQ ID NO: 1322 - RNA, 19 nt, Artificial Sequence
  Synthetic
aucaugcguucuccucaga

SEQ ID NO: 1323 - RNA, 19 nt, Artificial Sequence
  Synthetic
uauguauggguaggguaaa

SEQ ID NO: 1324 - RNA, 19 nt, Artificial Sequence
  Synthetic
guguuauuuggaaccuugu

SEQ ID NO: 1325 - RNA, 19 nt, Artificial Sequence
  Synthetic
acagcuccucugacagagu

SEQ ID NO: 1326 - RNA, 19 nt, Artificial Sequence
  Synthetic
uauggacuaccaguugugg

SEQ ID NO: 1327 - RNA, 19 nt, Artificial Sequence
  Synthetic
auucuggugccacuaccac

SEQ ID NO: 1328 - RNA, 19 nt, Artificial Sequence
  Synthetic
ugccuccaggugacagcaa

SEQ ID NO: 1329 - RNA, 19 nt, Artificial Sequence
  Synthetic
uaccucccaaguccuguau

SEQ ID NO: 1330 - RNA, 19 nt, Artificial Sequence
  Synthetic
ccagacacgcuaucaugcg

SEQ ID NO: 1331 - RNA, 19 nt, Artificial Sequence
  Synthetic
ugaugcagaacuugccaca

SEQ ID NO: 1332 - RNA, 19 nt, Artificial Sequence
  Synthetic
guuuagcuggugggcugca

SEQ ID NO: 1333 - RNA, 19 nt, Artificial Sequence
  Synthetic
gucugccaaguggguggua

SEQ ID NO: 1334 - RNA, 19 nt, Artificial Sequence
  Synthetic
gguuguaccggagcccuuc

SEQ ID NO: 1335 - RNA, 19 nt, Artificial Sequence
  Synthetic
guaccggagcccuucacau

SEQ ID NO: 1336 - RNA, 19 nt, Artificial Sequence
  Synthetic
caauccugaggaagaggau

SEQ ID NO: 1337 - RNA, 19 nt, Artificial Sequence
  Synthetic
gcuaucugucugcucuagu

SEQ ID NO: 1338 - RNA, 19 nt, Artificial Sequence
  Synthetic
ugacagauccaagucaacg

SEQ ID NO: 1339 - RNA, 19 nt, Artificial Sequence
  Synthetic
caugauggaacaugagaug

SEQ ID NO: 1340 - RNA, 19 nt, Artificial Sequence
  Synthetic
uuggacucucaggaaucuu

SEQ ID NO: 1341 - RNA, 19 nt, Artificial Sequence
  Synthetic
cucuucgucaucugaccag

SEQ ID NO: 1342 - RNA, 19 nt, Artificial Sequence
  Synthetic
uugcccuuugucccgcaaa

SEQ ID NO: 1343 - RNA, 19 nt, Artificial Sequence
  Synthetic
gaagcagagauggcccaga

SEQ ID NO: 1344 - RNA, 19 nt, Artificial Sequence
  Synthetic
ccuugcauaaccuuuccca

SEQ ID NO: 1345 - RNA, 19 nt, Artificial Sequence
  Synthetic
caguuugaugcugcucauc

SEQ ID NO: 1346 - RNA, 19 nt, Artificial Sequence
  Synthetic
accugacagauccaaguca

SEQ ID NO: 1347 - RNA, 19 nt, Artificial Sequence
  Synthetic
cuuucagaugcugcaacua

SEQ ID NO: 1348 - RNA, 19 nt, Artificial Sequence
  Synthetic
gauacgaugcuucaagaga

SEQ ID NO: 1349 - RNA, 19 nt, Artificial Sequence
  Synthetic
augcaagcuuuaggacuuc

SEQ ID NO: 1350 - RNA, 19 nt, Artificial Sequence
  Synthetic
ggauguggauaccucccaa

SEQ ID NO: 1351 - RNA, 19 nt, Artificial Sequence
  Synthetic
agaaugcaguucgccuuca

SEQ ID NO: 1352 - RNA, 19 nt, Artificial Sequence
  Synthetic
cgaaaucuugcccuuuguc

SEQ ID NO: 1353 - RNA, 19 nt, Artificial Sequence
  Synthetic
acucaagaacaaguagcug

SEQ ID NO: 1354 - RNA, 19 nt, Artificial Sequence
  Synthetic
gaaugaagguguggcgaca

SEQ ID NO: 1355 - RNA, 19 nt, Artificial Sequence
  Synthetic
ugcaccuuugcgugagcag

SEQ ID NO: 1356 - RNA, 19 nt, Artificial Sequence
  Synthetic
acgagcugcuauguucccu

SEQ ID NO: 1357 - RNA, 19 nt, Artificial Sequence
  Synthetic
aagaggauguggauaccuc

SEQ ID NO: 1358 - RNA, 19 nt, Artificial Sequence
  Synthetic
gauauggccaggaugccuu

SEQ ID NO: 1359 - RNA, 19 nt, Artificial Sequence
  Synthetic
uauagaggcucuugugcgu

SEQ ID NO: 1360 - RNA, 19 nt, Artificial Sequence
  Synthetic
gguucagaugauauaaaug

SEQ ID NO: 1361 - RNA, 19 nt, Artificial Sequence
  Synthetic
agggauggaaggucuccuu

SEQ ID NO: 1362 - RNA, 19 nt, Artificial Sequence
  Synthetic
uaucccaaaguuguuguaa

SEQ ID NO: 1363 - RNA, 19 nt, Artificial Sequence
  Synthetic
ucucucuucagaacagagc

SEQ ID NO: 1364 - RNA, 19 nt, Artificial Sequence
  Synthetic
cugaccagcucucucuuca

SEQ ID NO: 1365 - RNA, 19 nt, Artificial Sequence
  Synthetic
accugcugugauacgaugc

SEQ ID NO: 1366 - RNA, 19 nt, Artificial Sequence
  Synthetic
auggcagugcguuuagcug

SEQ ID NO: 1367 - RNA, 19 nt, Artificial Sequence
  Synthetic
auccaagucaacgucuugu

SEQ ID NO: 1368 - RNA, 19 nt, Artificial Sequence
  Synthetic
gcugccuccaggugacagc

SEQ ID NO: 1369 - RNA, 19 nt, Artificial Sequence
  Synthetic
agugcguuuagcugguggg

SEQ ID NO: 1370 - RNA, 19 nt, Artificial Sequence
  Synthetic
agccggcuauuguagaagc

SEQ ID NO: 1371 - RNA, 19 nt, Artificial Sequence
  Synthetic
cauuagaugagggcaugca

SEQ ID NO: 1372 - RNA, 19 nt, Artificial Sequence
  Synthetic
gaagguguggcgacauaug

SEQ ID NO: 1373 - RNA, 19 nt, Artificial Sequence
  Synthetic
aagugggugguauagaggc

SEQ ID NO: 1374 - RNA, 19 nt, Artificial Sequence
  Synthetic
cugagggagccacagcucc

SEQ ID NO: 1375 - RNA, 19 nt, Artificial Sequence
  Synthetic
gcguuuggcugaaccauca

SEQ ID NO: 1376 - RNA, 19 nt, Artificial Sequence
  Synthetic
uccuucucugagugguaaa

SEQ ID NO: 1377 - RNA, 19 nt, Artificial Sequence
  Synthetic
gcaguucgccuucacuaug

SEQ ID NO: 1378 - RNA, 19 nt, Artificial Sequence
  Synthetic
ggacuugauauuggugccc

SEQ ID NO: 1379 - RNA, 19 nt, Artificial Sequence
  Synthetic
guuuggcugaaccaucaca

SEQ ID NO: 1380 - RNA, 19 nt, Artificial Sequence
  Synthetic
gcaugcagaucccaucuac

SEQ ID NO: 1381 - RNA, 19 nt, Artificial Sequence
  Synthetic
gaugggcugccagaucugg

SEQ ID NO: 1382 - RNA, 19 nt, Artificial Sequence
  Synthetic
ggacuucaccugacagauc

SEQ ID NO: 1383 - RNA, 19 nt, Artificial Sequence
  Synthetic
caacgucuuguucagaacu

SEQ ID NO: 1384 - RNA, 19 nt, Artificial Sequence
  Synthetic
gauauugauggacaguaug

SEQ ID NO: 1385 - RNA, 19 nt, Artificial Sequence
  Synthetic
uggccauggaaccagacag

SEQ ID NO: 1386 - RNA, 19 nt, Artificial Sequence
  Synthetic
caagaacaaguagcugaua

SEQ ID NO: 1387 - RNA, 19 nt, Artificial Sequence
  Synthetic
ggcuguuagucacuggcag

SEQ ID NO: 1388 - RNA, 19 nt, Artificial Sequence
  Synthetic
cauuguuugugcagcugcu

SEQ ID NO: 1389 - RNA, 19 nt, Artificial Sequence
  Synthetic
uaaacaggaagggauggaa

SEQ ID NO: 1390 - RNA, 19 nt, Artificial Sequence
  Synthetic
auaagaacaagaugauggu

SEQ ID NO: 1391 - RNA, 19 nt, Artificial Sequence
  Synthetic
guggaaugcaagcuuuagg

SEQ ID NO: 1392 - RNA, 19 nt, Artificial Sequence
  Synthetic
ggaaugaagguguggcgac

SEQ ID NO: 1393 - RNA, 19 nt, Artificial Sequence
  Synthetic
gacaccaagaagcagagau

SEQ ID NO: 1394 - RNA, 19 nt, Artificial Sequence
  Synthetic
acugucuuuggacucucag

SEQ ID NO: 1395 - RNA, 19 nt, Artificial Sequence
  Synthetic
ggacaaggaagcugcagaa

SEQ ID NO: 1396 - RNA, 19 nt, Artificial Sequence
  Synthetic
ucugcuauuguacguacca

SEQ ID NO: 1397 - RNA, 19 nt, Artificial Sequence
  Synthetic
agcugcuuuauucucccau

SEQ ID NO: 1398 - RNA, 19 nt, Artificial Sequence
  Synthetic
aggguacgagcugcuaugu

SEQ ID NO: 1399 - RNA, 19 nt, Artificial Sequence
  Synthetic
gaagacaucacugagccug

SEQ ID NO: 1400 - RNA, 19 nt, Artificial Sequence
  Synthetic
cgggauguucacaaccgaa

SEQ ID NO: 1401 - RNA, 19 nt, Artificial Sequence
  Synthetic
cagccgacaccaagaagca

SEQ ID NO: 1402 - RNA, 19 nt, Artificial Sequence
  Synthetic
uguucacaaccgaauuguu

SEQ ID NO: 1403 - RNA, 19 nt, Artificial Sequence
  Synthetic
gcucucucuucagaacaga

SEQ ID NO: 1404 - RNA, 19 nt, Artificial Sequence
  Synthetic
ucagauggugucugcuauu

SEQ ID NO: 1405 - RNA, 19 nt, Artificial Sequence
  Synthetic
ugagugguaaaggcaaucc

SEQ ID NO: 1406 - RNA, 19 nt, Artificial Sequence
  Synthetic
uggugccacuaccacagcu

SEQ ID NO: 1407 - RNA, 19 nt, Artificial Sequence
  Synthetic
uugucccgcaaaucaugca

SEQ ID NO: 1408 - RNA, 19 nt, Artificial Sequence
  Synthetic
cacccuggugcugacuauc

SEQ ID NO: 1409 - RNA, 19 nt, Artificial Sequence
  Synthetic
aauguccagcguuuggcug

SEQ ID NO: 1410 - RNA, 19 nt, Artificial Sequence
  Synthetic
gggcugccuccaggugaca

SEQ ID NO: 1411 - RNA, 19 nt, Artificial Sequence
  Synthetic
gaguuacuucacucuagga

SEQ ID NO: 1412 - RNA, 19 nt, Artificial Sequence
  Synthetic
uucgaaaucuugcccuuug

SEQ ID NO: 1413 - RNA, 19 nt, Artificial Sequence
  Synthetic
guauagaggcucuugugcg

SEQ ID NO: 1414 - RNA, 19 nt, Artificial Sequence
  Synthetic
agcugaccagcucucucuu

SEQ ID NO: 1415 - RNA, 19 nt, Artificial Sequence
  Synthetic
cuauuguacguaccaugca

SEQ ID NO: 1416 - RNA, 19 nt, Artificial Sequence
  Synthetic
uaugcaaugacucgagcuc

SEQ ID NO: 1417 - RNA, 19 nt, Artificial Sequence
  Synthetic
ugcccaggaccucauggau

SEQ ID NO: 1418 - RNA, 19 nt, Artificial Sequence
  Synthetic
aacaaguagcugauauuga

SEQ ID NO: 1419 - RNA, 19 nt, Artificial Sequence
  Synthetic
aaggcaauccugaggaaga

SEQ ID NO: 1420 - RNA, 19 nt, Artificial Sequence
  Synthetic
caagaugauggucugccaa

SEQ ID NO: 1421 - RNA, 19 nt, Artificial Sequence
  Synthetic
ugccauuacaacucuccac

SEQ ID NO: 1422 - RNA, 19 nt, Artificial Sequence
  Synthetic
auguauggguaggguaaau

SEQ ID NO: 1423 - RNA, 19 nt, Artificial Sequence
  Synthetic
ugugcucuucgucaucuga

SEQ ID NO: 1424 - RNA, 19 nt, Artificial Sequence
  Synthetic
aaggcuacuguuggauuga

SEQ ID NO: 1425 - RNA, 19 nt, Artificial Sequence
  Synthetic
uacuguccuucgggcuggu

SEQ ID NO: 1426 - RNA, 19 nt, Artificial Sequence
  Synthetic
auaaggcugcaguuauggu

SEQ ID NO: 1427 - RNA, 19 nt, Artificial Sequence
  Synthetic
ucgucaucugaccagccga

SEQ ID NO: 1428 - RNA, 19 nt, Artificial Sequence
  Synthetic
guuguaaccugcugugaua

SEQ ID NO: 1429 - RNA, 19 nt, Artificial Sequence
  Synthetic
aagauuacaagaaacggcu

SEQ ID NO: 1430 - RNA, 19 nt, Artificial Sequence
  Synthetic
uuauggcaaccaagaaagc

SEQ ID NO: 1431 - RNA, 19 nt, Artificial Sequence
  Synthetic
uccaguugaugggcugcca

SEQ ID NO: 1432 - RNA, 19 nt, Artificial Sequence
  Synthetic
gggacacagcagcaauuug

SEQ ID NO: 1433 - RNA, 19 nt, Artificial Sequence
  Synthetic
augauggaacaugagaugg

SEQ ID NO: 1434 - RNA, 19 nt, Artificial Sequence
  Synthetic
uauuugggauauguauggg

SEQ ID NO: 1435 - RNA, 19 nt, Artificial Sequence
  Synthetic
cagcugcuuuauucuccca

SEQ ID NO: 1436 - RNA, 19 nt, Artificial Sequence
  Synthetic
gcuacucaagcugauuuga

SEQ ID NO: 1437 - RNA, 19 nt, Artificial Sequence
  Synthetic
ucccugagacauuagauga

SEQ ID NO: 1438 - RNA, 19 nt, Artificial Sequence
  Synthetic
guggauaccucccaagucc

SEQ ID NO: 1439 - RNA, 19 nt, Artificial Sequence
  Synthetic
uaggaaugaagguguggcg

SEQ ID NO: 1440 - RNA, 19 nt, Artificial Sequence
  Synthetic
ugacagaguuacuucacuc

SEQ ID NO: 1441 - RNA, 19 nt, Artificial Sequence
  Synthetic
agcggcuguuagucacugg

SEQ ID NO: 1442 - RNA, 19 nt, Artificial Sequence
  Synthetic
augguucagaauuaaacuu

SEQ ID NO: 1443 - RNA, 19 nt, Artificial Sequence
  Synthetic
aaccgaauuguuaucagag

SEQ ID NO: 1444 - RNA, 19 nt, Artificial Sequence
  Synthetic
gggugccauuccacgacua

SEQ ID NO: 1445 - RNA, 19 nt, Artificial Sequence
  Synthetic
augauggucugccaagugg

SEQ ID NO: 1446 - RNA, 19 nt, Artificial Sequence
  Synthetic
cacaucaggauacccagcg

SEQ ID NO: 1447 - RNA, 19 nt, Artificial Sequence
  Synthetic
aggaaugaagguguggcga

SEQ ID NO: 1448 - RNA, 19 nt, Artificial Sequence
  Synthetic
gaaggugcuaucugucugc

SEQ ID NO: 1449 - RNA, 19 nt, Artificial Sequence
  Synthetic
ccaagaaagcaagcucauc

SEQ ID NO: 1450 - RNA, 19 nt, Artificial Sequence
  Synthetic
cgagcugcuauguucccug

SEQ ID NO: 1451 - RNA, 19 nt, Artificial Sequence
  Synthetic
ccuggugcugacuauccag

SEQ ID NO: 1452 - RNA, 19 nt, Artificial Sequence
  Synthetic
ugcuaucugucugcucuag

SEQ ID NO: 1453 - RNA, 19 nt, Artificial Sequence
  Synthetic
auuguagaagcugguggaa

SEQ ID NO: 1454 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(5): 2'-deoxy
  misc_feature (6)..(8): 2'-deoxy-2'-fluoro
  misc_feature (9)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (21)..(21): inverted abasic cap
ucgagcucagaggguacgatt

SEQ ID NO: 1455 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(11): 2'-deoxy-2'-fluoro
  misc_feature (12)..(13): 2'-O-methyl
  misc_feature (15)..(17): 2'-deoxy-2'-fluoro
  misc_feature (18)..(21): 2'-O-methyl
ucguacccucugagcucgauu

SEQ ID NO: 1456 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(9): 2'-deoxy-2'-fluoro
  misc_feature (10)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (21)..(21): inverted abasic cap
gaggcucuugugcguacugtt

SEQ ID NO: 1457 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (15)..(15): 2'-O-methyl
  misc_feature (16)..(19): 2'-deoxy-2'-fluoro
  misc_feature (20)..(21): 2'-O-methyl
caguacgcacaagagccucuu

SEQ ID NO: 1458 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(4): 2'-deoxy-2'-fluoro
  misc_feature (5)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
gcccagaaugcaguucgcctt

SEQ ID NO: 1459 - RNA, 21 nt, Artificial Sequence
  Synthetic
  misc_feature (4)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(15): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
ggcgaacugcauucugggcuu

SEQ ID NO: 1460 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(7): 2'-deoxy-2'-fluoro
  misc_feature (8)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (21)..(21): inverted abasic cap
cgagcucagaggguacgagtt

SEQ ID NO: 1461 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(12): 2'-deoxy-2'-fluoro
  misc_feature (13)..(13): 2'-O-methyl
  misc_feature (15)..(15): 2'-O-methyl
  misc_feature (16)..(18): 2'-deoxy-2'-fluoro
  misc_feature (19)..(21): 2'-O-methyl
cucguacccucugagcucguu

SEQ ID NO: 1462 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(5): 2'-deoxy-2'-fluoro
  misc_feature (6)..(8): 2'-deoxy
  misc_feature (9)..(10): 2'-deoxy-2'-fluoro
  misc_feature (11)..(12): 2'-deoxy
  misc_feature (13)..(15): 2'-deoxy-2'-fluoro
  misc_feature (16)..(19): 2'-deoxy
  misc_feature (21)..(21): inverted abasic cap
cuguuggauugauucgaaatt

SEQ ID NO: 1463 - RNA, 21 nt, Artificial Sequence
  Synthetic
  misc_feature (4)..(4): 2'-deoxy-2'-fluoro
  misc_feature (5)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
uuucgaaucaauccaacaguu

SEQ ID NO: 1464 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
gucugcuauuguacguacctt

SEQ ID NO: 1465 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
gguacguacaauagcagacuu

SEQ ID NO: 1466 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(7): 2'-deoxy-2'-fluoro
  misc_feature (8)..(9): 2'-deoxy
  misc_feature (10)..(11): 2'-deoxy-2'-fluoro
  misc_feature (12)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
aauucuuggcuauuacgactt

SEQ ID NO: 1467 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (15)..(17): 2'-O-methyl
  misc_feature (18)..(19): 2'-deoxy-2'-fluoro
  misc_feature (20)..(21): 2'-O-methyl
gucguaauagccaagaauuuu

SEQ ID NO: 1468 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(4): 2'-deoxy-2'-fluoro
  misc_feature (5)..(5): 2'-deoxy
  misc_feature (6)..(8): 2'-deoxy-2'-fluoro
  misc_feature (9)..(9): 2'-deoxy
  misc_feature (10)..(10): 2'-deoxy-2'-fluoro
  misc_feature (11)..(12): 2'-deoxy
  misc_feature (13)..(14): 2'-deoxy-2'-fluoro
  misc_feature (15)..(17): 2'-deoxy
  misc_feature (18)..(19): 2'-deoxy-2'-fluoro
  misc_feature (21)..(21): inverted abasic cap
ggauguucacaaccgaauutt

SEQ ID NO: 1469 - RNA, 21 nt, Artificial Sequence
  Synthetic
  misc_feature (4)..(5): 2'-deoxy-2'-fluoro
  misc_feature (6)..(7): 2'-O-methyl
  misc_feature (8)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
aauucgguugugaacauccuu

SEQ ID NO: 1470 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(11): 2'-deoxy
  misc_feature (12)..(12): 2'-deoxy-2'-fluoro
  misc_feature (13)..(14): 2'-deoxy
  misc_feature (15)..(17): 2'-deoxy-2'-fluoro
  misc_feature (18)..(19): 2'-deoxy
  misc_feature (21)..(21): inverted abasic cap
acaguaugcaaugacucgatt

SEQ ID NO: 1471 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
ucgagucauugcauacuguuu

SEQ ID NO: 1472 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(7): 2'-deoxy-2'-fluoro
  misc_feature (8)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
agcuuccagacacgcuauctt

SEQ ID NO: 1473 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(12): 2'-deoxy-2'-fluoro
  misc_feature (13)..(13): 2'-O-methyl
  misc_feature (15)..(17): 2'-O-methyl
  misc_feature (18)..(19): 2'-deoxy-2'-fluoro
  misc_feature (20)..(21): 2'-O-methyl
gauagcgugucuggaagcuuu

SEQ ID NO: 1474 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
ugucugcuauuguacguactt

SEQ ID NO: 1475 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
guacguacaauagcagacauu

SEQ ID NO: 1476 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(6): 2'-deoxy-2'-fluoro
  misc_feature (7)..(9): 2'-deoxy
  misc_feature (10)..(11): 2'-deoxy-2'-fluoro
  misc_feature (12)..(13): 2'-deoxy
  misc_feature (14)..(16): 2'-deoxy-2'-fluoro
  misc_feature (17)..(19): 2'-deoxy
  misc_feature (21)..(21): inverted abasic cap
acuguuggauugauucgaatt

SEQ ID NO: 1477 - RNA, 21 nt, Artificial Sequence
  Synthetic
  misc_feature (4)..(6): 2'-O-methyl
  misc_feature (7)..(8): 2'-deoxy-2'-fluoro
  misc_feature (9)..(10): 2'-O-methyl
  misc_feature (11)..(13): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
uucgaaucaauccaacaguuu

SEQ ID NO: 1478 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(5): 2'-deoxy
  misc_feature (6)..(6): 2'-deoxy-2'-fluoro
  misc_feature (7)..(7): 2'-deoxy
  misc_feature (8)..(10): 2'-deoxy-2'-fluoro
  misc_feature (11)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
caggauacccagcgccguatt

SEQ ID NO: 1479 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(9): 2'-deoxy-2'-fluoro
  misc_feature (10)..(12): 2'-O-methyl
  misc_feature (13)..(13): 2'-deoxy-2'-fluoro
  misc_feature (15)..(18): 2'-deoxy-2'-fluoro
  misc_feature (19)..(21): 2'-O-methyl
uacggcgcuggguauccuguu

SEQ ID NO: 1480 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
gacacgcuaucaugcguuctt

SEQ ID NO: 1481 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
gaacgcaugauagcgugucuu

SEQ ID NO: 1482 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-deoxy
  misc_feature (6)..(7): 2'-deoxy-2'-fluoro
  misc_feature (8)..(10): 2'-deoxy
  misc_feature (11)..(12): 2'-deoxy-2'-fluoro
  misc_feature (13)..(14): 2'-deoxy
  misc_feature (15)..(17): 2'-deoxy-2'-fluoro
  misc_feature (18)..(19): 2'-deoxy
  misc_feature (21)..(21): inverted abasic cap
uacuguuggauugauucgatt

SEQ ID NO: 1483 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(9): 2'-O-methyl
  misc_feature (10)..(12): 2'-deoxy-2'-fluoro
  misc_feature (13)..(13): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
ucgaaucaauccaacaguauu

SEQ ID NO: 1484 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(5): 2'-deoxy-2'-fluoro
  misc_feature (6)..(7): 2'-deoxy
  misc_feature (8)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (21)..(21): inverted abasic cap
uucuuggcuauuacgacagtt

SEQ ID NO: 1485 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (13)..(14): 2'-deoxy-2'-fluoro
  misc_feature (15)..(21): 2'-O-methyl
cugucguaauagccaagaauu

SEQ ID NO: 1486 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (21)..(21): inverted abasic cap
acacgcuaucaugcguucutt

SEQ ID NO: 1487 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
agaacgcaugauagcguguuu

SEQ ID NO: 1488 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
cagacacgcuaucaugcgutt

SEQ ID NO: 1489 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
acgcaugauagcgugucuguu

SEQ ID NO: 1490 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(7): 2'-deoxy
  misc_feature (8)..(9): 2'-deoxy-2'-fluoro
  misc_feature (10)..(11): 2'-deoxy
  misc_feature (12)..(14): 2'-deoxy-2'-fluoro
  misc_feature (15)..(18): 2'-deoxy
  misc_feature (19)..(19): 2'-deoxy-2'-fluoro
  misc_feature (21)..(21): inverted abasic cap
uguuggauugauucgaaautt

SEQ ID NO: 1491 - RNA, 21 nt, Artificial Sequence
  Synthetic
  misc_feature (4)..(5): 2'-deoxy-2'-fluoro
  misc_feature (6)..(8): 2'-O-methyl
  misc_feature (9)..(10): 2'-deoxy-2'-fluoro
  misc_feature (11)..(12): 2'-O-methyl
  misc_feature (13)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
auuucgaaucaauccaacauu

SEQ ID NO: 1492 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(7): 2'-deoxy-2'-fluoro
  misc_feature (8)..(10): 2'-deoxy
  misc_feature (11)..(12): 2'-deoxy-2'-fluoro
  misc_feature (13)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
cagauccaagucaacgucutt

SEQ ID NO: 1493 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(9): 2'-O-methyl
  misc_feature (10)..(12): 2'-deoxy-2'-fluoro
  misc_feature (13)..(13): 2'-O-methyl
  misc_feature (15)..(15): 2'-O-methyl
  misc_feature (16)..(18): 2'-deoxy-2'-fluoro
  misc_feature (19)..(21): 2'-O-methyl
agacguugacuuggaucuguu

SEQ ID NO: 1494 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
aggcucuugugcguacugutt

SEQ ID NO: 1495 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (15)..(16): 2'-O-methyl
  misc_feature (17)..(19): 2'-deoxy-2'-fluoro
  misc_feature (20)..(21): 2'-O-methyl
acaguacgcacaagagccuuu

SEQ ID NO: 1496 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(14): 2'-deoxy-2'-fluoro
  misc_feature (15)..(17): 2'-deoxy
  misc_feature (18)..(19): 2'-deoxy-2'-fluoro
  misc_feature (21)..(21): inverted abasic cap
gcguacuguccuucgggcutt

SEQ ID NO: 1497 - RNA, 21 nt, Artificial Sequence
  Synthetic
  misc_feature (4)..(5): 2'-deoxy-2'-fluoro
  misc_feature (6)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
agcccgaaggacaguacgcuu

SEQ ID NO: 1498 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(10): 2'-deoxy-2'-fluoro
  misc_feature (11)..(12): 2'-deoxy
  misc_feature (13)..(13): 2'-deoxy-2'-fluoro
  misc_feature (14)..(14): 2'-deoxy
  misc_feature (15)..(17): 2'-deoxy-2'-fluoro
  misc_feature (18)..(19): 2'-deoxy
  misc_feature (21)..(21): inverted abasic cap
acuaauguccagcguuuggtt

SEQ ID NO: 1499 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(9): 2'-deoxy-2'-fluoro
  misc_feature (10)..(12): 2'-O-methyl
  misc_feature (13)..(13): 2'-deoxy-2'-fluoro
  misc_feature (15)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
ccaaacgcuggacauuaguuu

SEQ ID NO: 1500 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(4): 2'-deoxy
  misc_feature (5)..(8): 2'-deoxy-2'-fluoro
  misc_feature (9)..(10): 2'-deoxy
  misc_feature (11)..(13): 2'-deoxy-2'-fluoro
  misc_feature (14)..(17): 2'-deoxy
  misc_feature (18)..(18): 2'-deoxy-2'-fluoro
  misc_feature (19)..(19): 2'-deoxy
  misc_feature (21)..(21): inverted abasic cap
cacauccuagcucgggaugtt

SEQ ID NO: 1501 - RNA, 21 nt, Artificial Sequence
  Synthetic
  misc_feature (4)..(6): 2'-deoxy-2'-fluoro
  misc_feature (7)..(9): 2'-O-methyl
  misc_feature (10)..(11): 2'-deoxy-2'-fluoro
  misc_feature (12)..(13): 2'-O-methyl
  misc_feature (15)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
caucccgagcuaggauguguu

SEQ ID NO: 1502 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(6): 2'-deoxy-2'-fluoro
  misc_feature (7)..(13): 2'-deoxy
  misc_feature (14)..(16): 2'-deoxy-2'-fluoro
  misc_feature (17)..(19): 2'-deoxy
  misc_feature (21)..(21): inverted abasic cap
guugcugagagggcucgagtt

SEQ ID NO: 1503 - RNA, 21 nt, Artificial Sequence
  Synthetic
  misc_feature (4)..(6): 2'-O-methyl
  misc_feature (7)..(13): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
cucgagcccucucagcaacuu

SEQ ID NO: 1504 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(7): 2'-deoxy
  misc_feature (8)..(9): 2'-deoxy-2'-fluoro
  misc_feature (10)..(11): 2'-deoxy
  misc_feature (12)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
caucugaccagccgacacctt

SEQ ID NO: 1505 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(10): 2'-deoxy-2'-fluoro
  misc_feature (11)..(12): 2'-O-methyl
  misc_feature (13)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
ggugucggcuggucagauguu

SEQ ID NO: 1506 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(15): 2'-deoxy-2'-fluoro
  misc_feature (16)..(18): 2'-deoxy
  misc_feature (19)..(19): 2'-deoxy-2'-fluoro
  misc_feature (21)..(21): inverted abasic cap
ugcguacuguccuucgggctt

SEQ ID NO: 1507 - RNA, 21 nt, Artificial Sequence
  Synthetic
  misc_feature (4)..(4): 2'-deoxy-2'-fluoro
  misc_feature (5)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
gcccgaaggacaguacgcauu

SEQ ID NO: 1508 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(16): 2'-deoxy
  misc_feature (17)..(17): 2'-deoxy-2'-fluoro
  misc_feature (18)..(19): 2'-deoxy
  misc_feature (21)..(21): inverted abasic cap
acaagauuacaagaaacggtt

SEQ ID NO: 1509 - RNA, 21 nt, Artificial Sequence
  Synthetic
  misc_feature (4)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
ccguuucuuguaaucuuguuu

SEQ ID NO: 1510 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(8): 2'-deoxy
  misc_feature (9)..(11): 2'-deoxy-2'-fluoro
  misc_feature (12)..(13): 2'-deoxy
  misc_feature (14)..(15): 2'-deoxy-2'-fluoro
  misc_feature (16)..(17): 2'-deoxy
  misc_feature (18)..(19): 2'-deoxy-2'-fluoro
  misc_feature (21)..(21): inverted abasic cap
guuguaaacuugauuaacutt

SEQ ID NO: 1511 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
aguuaaucaaguuuacaacuu

SEQ ID NO: 1512 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(7): 2'-deoxy-2'-fluoro
  misc_feature (8)..(9): 2'-deoxy
  misc_feature (10)..(11): 2'-deoxy-2'-fluoro
  misc_feature (12)..(13): 2'-deoxy
  misc_feature (14)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (21)..(21): inverted abasic cap
uaaacuugauuaacuaucatt

SEQ ID NO: 1513 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (15)..(15): 2'-O-methyl
  misc_feature (16)..(18): 2'-deoxy-2'-fluoro
  misc_feature (19)..(21): 2'-O-methyl
ugauaguuaaucaaguuuauu

SEQ ID NO: 1514 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(6): 2'-deoxy
  misc_feature (7)..(7): 2'-deoxy-2'-fluoro
  misc_feature (8)..(12): 2'-deoxy
  misc_feature (13)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
auauaaugaggaccuauactt

SEQ ID NO: 1515 - RNA, 21 nt, Artificial Sequence
  Synthetic
  misc_feature (4)..(4): 2'-deoxy-2'-fluoro
  misc_feature (5)..(7): 2'-O-methyl
  misc_feature (8)..(12): 2'-deoxy-2'-fluoro
  misc_feature (13)..(13): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
guauagguccucauuauauuu

SEQ ID NO: 1516 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(6): 2'-deoxy-2'-fluoro
  misc_feature (7)..(8): 2'-deoxy
  misc_feature (9)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(17): 2'-deoxy-2'-fluoro
  misc_feature (18)..(19): 2'-deoxy
  misc_feature (21)..(21): inverted abasic cap
aaacuugauuaacuaucaatt

SEQ ID NO: 1517 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(11): 2'-O-methyl
  misc_feature (12)..(13): 2'-deoxy-2'-fluoro
  misc_feature (15)..(16): 2'-O-methyl
  misc_feature (17)..(19): 2'-deoxy-2'-fluoro
  misc_feature (20)..(21): 2'-O-methyl
uugauaguuaaucaaguuuuu

SEQ ID NO: 1518 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(5): 2'-deoxy-2'-fluoro
  misc_feature (6)..(7): 2'-deoxy
  misc_feature (8)..(9): 2'-deoxy-2'-fluoro
  misc_feature (10)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
gaaauaguugaagguuguatt

SEQ ID NO: 1519 - RNA, 21 nt, Artificial Sequence
  Synthetic
  misc_feature (4)..(5): 2'-O-methyl
  misc_feature (6)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(19): 2'-deoxy-2'-fluoro
  misc_feature (20)..(21): 2'-O-methyl
uacaaccuucaacuauuucuu

SEQ ID NO: 1520 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(10): 2'-deoxy
  misc_feature (11)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
auaaugaggaccuauacuutt

SEQ ID NO: 1521 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(9): 2'-O-methyl
  misc_feature (10)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aaguauagguccucauuauuu

SEQ ID NO: 1522 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(5): 2'-deoxy
  misc_feature (6)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
uuaaauucuuggcuauuactt

SEQ ID NO: 1523 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(13): 2'-O-methyl
  misc_feature (15)..(17): 2'-deoxy-2'-fluoro
  misc_feature (18)..(21): 2'-O-methyl
guaauagccaagaauuuaauu

SEQ ID NO: 1524 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(9): 2'-deoxy-2'-fluoro
  misc_feature (10)..(11): 2'-deoxy
  misc_feature (12)..(13): 2'-deoxy-2'-fluoro
  misc_feature (14)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
uguaaacuugauuaacuautt

SEQ ID NO: 1525 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(10): 2'-deoxy-2'-fluoro
  misc_feature (11)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
auaguuaaucaaguuuacauu

SEQ ID NO: 1526 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(5): 2'-deoxy
  misc_feature (6)..(8): 2'-deoxy-2'-fluoro
  misc_feature (9)..(10): 2'-deoxy
  misc_feature (11)..(12): 2'-deoxy-2'-fluoro
  misc_feature (13)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
guaaacuugauuaacuauctt

SEQ ID NO: 1527 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(9): 2'-O-methyl
  misc_feature (10)..(11): 2'-deoxy-2'-fluoro
  misc_feature (12)..(13): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
gauaguuaaucaaguuuacuu

SEQ ID NO: 1528 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(7): 2'-deoxy
  misc_feature (8)..(10): 2'-deoxy-2'-fluoro
  misc_feature (11)..(12): 2'-deoxy
  misc_feature (13)..(14): 2'-deoxy-2'-fluoro
  misc_feature (15)..(16): 2'-deoxy
  misc_feature (17)..(18): 2'-deoxy-2'-fluoro
  misc_feature (19)..(19): 2'-deoxy
  misc_feature (21)..(21): inverted abasic cap
uuguaaacuugauuaacuatt

SEQ ID NO: 1529 - RNA, 21 nt, Artificial Sequence
  Synthetic
  misc_feature (4)..(5): 2'-deoxy-2'-fluoro
  misc_feature (6)..(7): 2'-O-methyl
  misc_feature (8)..(9): 2'-deoxy-2'-fluoro
  misc_feature (10)..(12): 2'-O-methyl
  misc_feature (13)..(15): 2'-deoxy-2'-fluoro
  misc_feature (16)..(16): 2'-O-methyl
  misc_feature (17)..(17): 2'-deoxy-2'-fluoro
  misc_feature (18)..(21): 2'-O-methyl
uaguuaaucaaguuuacaauu

SEQ ID NO: 1530 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(5): 2'-deoxy-2'-fluoro
  misc_feature (6)..(7): 2'-deoxy
  misc_feature (8)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (21)..(21): inverted abasic cap
gcuuuaguaaauauaaugatt

SEQ ID NO: 1531 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(14): 2'-deoxy-2'-fluoro
  misc_feature (15)..(18): 2'-O-methyl
  misc_feature (19)..(19): 2'-deoxy-2'-fluoro
  misc_feature (20)..(21): 2'-O-methyl
ucauuauauuuacuaaagcuu

SEQ ID NO: 1532 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
uggccaccacccuggugcutt

SEQ ID NO: 1533 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
agcaccagggugguggccauu

SEQ ID NO: 1534 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy-2'-fluoro
  misc_feature (5)..(6): 2'-deoxy
  misc_feature (7)..(7): 2'-deoxy-2'-fluoro
  misc_feature (8)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(19): 2'-deoxy
  misc_feature (21)..(21): inverted abasic cap
cuuuaguaaauauaaugagtt

SEQ ID NO: 1535 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(12): 2'-deoxy-2'-fluoro
  misc_feature (13)..(13): 2'-O-methyl
  misc_feature (14)..(15): 2'-deoxy-2'-fluoro
  misc_feature (16)..(21): 2'-O-methyl
cucauuauauuuacuaaaguu

SEQ ID NO: 1536 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(5): 2'-deoxy
  misc_feature (6)..(6): 2'-deoxy-2'-fluoro
  misc_feature (7)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(19): 2'-deoxy
  misc_feature (21)..(21): inverted abasic cap
uuuaguaaauauaaugaggtt

SEQ ID NO: 1537 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(13): 2'-deoxy-2'-fluoro
  misc_feature (15)..(16): 2'-deoxy-2'-fluoro
  misc_feature (17)..(21): 2'-O-methyl
ccucauuauauuuacuaaauu

SEQ ID NO: 1538 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(5): 2'-deoxy
  misc_feature (6)..(7): 2'-deoxy-2'-fluoro
  misc_feature (8)..(8): 2'-deoxy
  misc_feature (9)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): inverted abasic cap
guaaaucguccuuuagguatt

SEQ ID NO: 1539 - RNA, 21 nt, Artificial Sequence
  Synthetic
  misc_feature (4)..(5): 2'-deoxy-2'-fluoro
  misc_feature (6)..(11): 2'-O-methyl
  misc_feature (12)..(12): 2'-deoxy-2'-fluoro
  misc_feature (13)..(13): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
uaccuaaaggacgauuuacuu

SEQ ID NO: 1540 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(5): 2'-deoxy-2'-fluoro
  misc_feature (6)..(6): 2'-deoxy
  misc_feature (7)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(14): 2'-deoxy-2'-fluoro
  misc_feature (15)..(16): 2'-deoxy
  misc_feature (17)..(18): 2'-deoxy-2'-fluoro
  misc_feature (19)..(19): 2'-deoxy
  misc_feature (21)..(21): inverted abasic cap
accucacuugcaauaauuatt

SEQ ID NO: 1541 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (20)..(21): 2'-O-methyl
uaauuauugcaagugagguuu

SEQ ID NO: 1542 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-deoxy
  misc_feature (6)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
uaccauuccauuguuugugtt

SEQ ID NO: 1543 - RNA, 21 nt, Artificial Sequence
  Synthetic
  misc_feature (4)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(13): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
cacaaacaauggaaugguauu

SEQ ID NO: 1544 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(9): 2'-deoxy
  misc_feature (10)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (21)..(21): inverted abasic cap
uccaaagaguagcugcaggtt

SEQ ID NO: 1545 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(10): 2'-O-methyl
  misc_feature (11)..(16): 2'-deoxy-2'-fluoro
  misc_feature (17)..(21): 2'-O-methyl
ccugcagcuacucuuuggauu

SEQ ID NO: 1546 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(7): 2'-deoxy
  misc_feature (8)..(9): 2'-deoxy-2'-fluoro
  misc_feature (10)..(11): 2'-deoxy
  misc_feature (12)..(12): 2'-deoxy-2'-fluoro
  misc_feature (13)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
uauccaguugaugggcugctt

SEQ ID NO: 1547 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(8): 2'-O-methyl
  misc_feature (9)..(10): 2'-deoxy-2'-fluoro
  misc_feature (11)..(12): 2'-O-methyl
  misc_feature (13)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
gcagcccaucaacuggauauu

SEQ ID NO: 1548 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
caugcagaauacaaaugautt

SEQ ID NO: 1549 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
aucauuuguauucugcauguu

SEQ ID NO: 1550 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(8): 2'-deoxy
  misc_feature (9)..(9): 2'-deoxy-2'-fluoro
  misc_feature (10)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(19): 2'-deoxy
  misc_feature (21)..(21): inverted abasic cap
ccaaagaguagcugcagggtt

SEQ ID NO: 1551 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(10): 2'-deoxy-2'-fluoro
  misc_feature (11)..(11): 2'-O-methyl
  misc_feature (12)..(17): 2'-deoxy-2'-fluoro
  misc_feature (18)..(21): 2'-O-methyl
cccugcagcuacucuuugguu

SEQ ID NO: 1552 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-deoxy
  misc_feature (6)..(9): 2'-deoxy-2'-fluoro
  misc_feature (10)..(10): 2'-deoxy
  misc_feature (11)..(12): 2'-deoxy-2'-fluoro
  misc_feature (13)..(14): 2'-deoxy
  misc_feature (15)..(19): 2'-deoxy-2'-fluoro
  misc_feature (21)..(21): inverted abasic cap
caccaucccacuggccucutt

SEQ ID NO: 1553 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(9): 2'-O-methyl
  misc_feature (10)..(10): 2'-deoxy-2'-fluoro
  misc_feature (11)..(13): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
agaggccagugggaugguguu

SEQ ID NO: 1554 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): inverted abasic cap
accaugcagaauacaaaugtt

SEQ ID NO: 1555 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
cauuuguauucugcaugguuu

SEQ ID NO: 1556 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(11): 2'-deoxy-2'-fluoro
  misc_feature (12)..(14): 2'-deoxy
  misc_feature (15)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
aagacaucacugagccugctt

SEQ ID NO: 1557 - RNA, 21 nt, Artificial Sequence
  Synthetic
  misc_feature (4)..(5): 2'-O-methyl
  misc_feature (6)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (20)..(21): 2'-O-methyl
gcaggcucagugaugucuuuu

SEQ ID NO: 1558 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(4): 2'-deoxy-2'-fluoro
  misc_feature (5)..(6): 2'-deoxy
  misc_feature (7)..(8): 2'-deoxy-2'-fluoro
  misc_feature (9)..(10): 2'-deoxy
  misc_feature (11)..(13): 2'-deoxy-2'-fluoro
  misc_feature (14)..(15): 2'-deoxy
  misc_feature (16)..(18): 2'-deoxy-2'-fluoro
  misc_feature (19)..(19): 2'-deoxy
  misc_feature (21)..(21): inverted abasic cap
aaucagcuggccugguuugtt

SEQ ID NO: 1559 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(9): 2'-O-methyl
  misc_feature (10)..(11): 2'-deoxy-2'-fluoro
  misc_feature (12)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
caaaccaggccagcugauuuu

SEQ ID NO: 1560 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(6): 2'-deoxy-2'-fluoro
  misc_feature (7)..(7): 2'-deoxy
  misc_feature (8)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(17): 2'-deoxy
  misc_feature (18)..(19): 2'-deoxy-2'-fluoro
  misc_feature (21)..(21): inverted abasic cap
aaccucacuugcaauaauutt

SEQ ID NO: 1561 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(12): 2'-O-methyl
  misc_feature (13)..(13): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
aauuauugcaagugagguuuu

SEQ ID NO: 1562 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(5): 2'-deoxy-2'-fluoro
  misc_feature (6)..(6): 2'-deoxy
  misc_feature (7)..(7): 2'-deoxy-2'-fluoro
  misc_feature (8)..(10): 2'-deoxy
  misc_feature (11)..(11): 2'-deoxy-2'-fluoro
  misc_feature (12)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
accucauggaugggcugcctt

SEQ ID NO: 1563 - RNA, 21 nt, Artificial Sequence
  Synthetic
  misc_feature (4)..(5): 2'-O-methyl
  misc_feature (6)..(8): 2'-deoxy-2'-fluoro
  misc_feature (9)..(9): 2'-O-methyl
  misc_feature (10)..(12): 2'-deoxy-2'-fluoro
  misc_feature (13)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (20)..(21): 2'-O-methyl
ggcagcccauccaugagguuu

SEQ ID NO: 1564 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(8): 2'-deoxy-2'-fluoro
  misc_feature (9)..(9): 2'-deoxy
  misc_feature (10)..(11): 2'-deoxy-2'-fluoro
  misc_feature (12)..(12): 2'-deoxy
  misc_feature (13)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
accauuccauuguuugugctt

SEQ ID NO: 1565 - RNA, 21 nt, Artificial Sequence
  Synthetic
  misc_feature (4)..(4): 2'-deoxy-2'-fluoro
  misc_feature (5)..(7): 2'-O-methyl
  misc_feature (8)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
gcacaaacaauggaaugguuu

SEQ ID NO: 1566 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (7)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(16): 2'-deoxy
  misc_feature (17)..(17): 2'-deoxy-2'-fluoro
  misc_feature (18)..(19): 2'-deoxy
  misc_feature (21)..(21): inverted abasic cap
ccaugcagaauacaaaugatt

SEQ ID NO: 1567 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(13): 2'-deoxy-2'-fluoro
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(21): 2'-O-methyl
ucauuuguauucugcaugguu

SEQ ID NO: 1568 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(11): 2'-deoxy-2'-fluoro
  misc_feature (12)..(13): 2'-deoxy
  misc_feature (14)..(15): 2'-deoxy-2'-fluoro
  misc_feature (16)..(17): 2'-deoxy
  misc_feature (18)..(19): 2'-deoxy-2'-fluoro
  misc_feature (21)..(21): inverted abasic cap
cuucgucaucugaccagcctt

SEQ ID NO: 1569 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(21): 2'-O-methyl
ggcuggucagaugacgaaguu

SEQ ID NO: 1570 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(7): 2'-deoxy
  misc_feature (8)..(10): 2'-deoxy-2'-fluoro
  misc_feature (11)..(11): 2'-deoxy
  misc_feature (12)..(14): 2'-deoxy-2'-fluoro
  misc_feature (15)..(18): 2'-deoxy
  misc_feature (19)..(19): 2'-deoxy-2'-fluoro
  misc_feature (21)..(21): inverted abasic cap
cugugaacuugcucaggactt

SEQ ID NO: 1571 - RNA, 21 nt, Artificial Sequence
  Synthetic
  misc_feature (4)..(5): 2'-deoxy-2'-fluoro
  misc_feature (6)..(8): 2'-O-methyl
  misc_feature (9)..(9): 2'-deoxy-2'-fluoro
  misc_feature (10)..(12): 2'-O-methyl
  misc_feature (13)..(15): 2'-deoxy-2'-fluoro
  misc_feature (16)..(16): 2'-O-methyl
  misc_feature (17)..(17): 2'-deoxy-2'-fluoro
  misc_feature (18)..(21): 2'-O-methyl
guccugagcaaguucacaguu

SEQ ID NO: 1572 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(13): 2'-deoxy
  misc_feature (14)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
agacaucacugagccugcctt

SEQ ID NO: 1573 - RNA, 21 nt, Artificial Sequence
  Synthetic
  misc_feature (4)..(6): 2'-O-methyl
  misc_feature (7)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
ggcaggcucagugaugucuuu

SEQ ID NO: 1574 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(5): 2'-deoxy-2'-fluoro
  misc_feature (6)..(7): 2'-deoxy
  misc_feature (8)..(8): 2'-deoxy-2'-fluoro
  misc_feature (9)..(10): 2'-deoxy
  misc_feature (11)..(13): 2'-deoxy-2'-fluoro
  misc_feature (14)..(17): 2'-deoxy
  misc_feature (18)..(18): 2'-deoxy-2'-fluoro
  misc_feature (19)..(19): 2'-deoxy
  misc_feature (21)..(21): inverted abasic cap
gagccaauggcuuggaaugtt

SEQ ID NO: 1575 - RNA, 21 nt, Artificial Sequence
  Synthetic
  misc_feature (4)..(6): 2'-deoxy-2'-fluoro
  misc_feature (7)..(9): 2'-O-methyl
  misc_feature (10)..(11): 2'-deoxy-2'-fluoro
  misc_feature (12)..(12): 2'-O-methyl
  misc_feature (13)..(14): 2'-deoxy-2'-fluoro
  misc_feature (15)..(16): 2'-O-methyl
  misc_feature (17)..(19): 2'-deoxy-2'-fluoro
  misc_feature (20)..(21): 2'-O-methyl
cauuccaagccauuggcucuu

SEQ ID NO: 1576 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(6): 2'-deoxy
  misc_feature (7)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
acugagccugccaucugugtt

SEQ ID NO: 1577 - RNA, 21 nt, Artificial Sequence
  Synthetic
  misc_feature (4)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(13): 2'-O-methyl
  misc_feature (14)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
cacagauggcaggcucaguuu

SEQ ID NO: 1578 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(7): 2'-deoxy
  misc_feature (8)..(9): 2'-deoxy-2'-fluoro
  misc_feature (10)..(16): 2'-deoxy
  misc_feature (17)..(18): 2'-deoxy-2'-fluoro
  misc_feature (19)..(19): 2'-deoxy
  misc_feature (21)..(21): inverted abasic cap
auugaagcugagggagccatt

SEQ ID NO: 1579 - RNA, 21 nt, Artificial Sequence
  Synthetic
  misc_feature (4)..(10): 2'-deoxy-2'-fluoro
  misc_feature (11)..(12): 2'-O-methyl
  misc_feature (13)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
uggcucccucagcuucaauuu

SEQ ID NO: 1580 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(7): 2'-deoxy
  misc_feature (8)..(10): 2'-deoxy-2'-fluoro
  misc_feature (11)..(11): 2'-deoxy
  misc_feature (12)..(13): 2'-deoxy-2'-fluoro
  misc_feature (14)..(15): 2'-deoxy
  misc_feature (16)..(19): 2'-deoxy-2'-fluoro
  misc_feature (21)..(21): inverted abasic cap
guuaugguccaucagcuuutt

SEQ ID NO: 1581 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(9): 2'-deoxy-2'-fluoro
  misc_feature (10)..(12): 2'-O-methyl
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
aaagcugauggaccauaacuu

SEQ ID NO: 1582 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(7): 2'-deoxy
  misc_feature (8)..(9): 2'-deoxy-2'-fluoro
  misc_feature (10)..(10): 2'-deoxy
  misc_feature (11)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(19): 2'-deoxy
  misc_feature (21)..(21): inverted abasic cap
aauguggucaccugugcagtt

SEQ ID NO: 1583 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(9): 2'-O-methyl
  misc_feature (10)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
cugcacaggugaccacauuuu

SEQ ID NO: 1584 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(4): 2'-deoxy-2'-fluoro
  misc_feature (5)..(6): 2'-deoxy
  misc_feature (7)..(9): 2'-deoxy-2'-fluoro
  misc_feature (10)..(11): 2'-deoxy
  misc_feature (12)..(14): 2'-deoxy-2'-fluoro
  misc_feature (15)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
agcuggccugguuugauactt

SEQ ID NO: 1585 - RNA, 21 nt, Artificial Sequence
  Synthetic
  misc_feature (4)..(5): 2'-deoxy-2'-fluoro
  misc_feature (6)..(8): 2'-O-methyl
  misc_feature (9)..(10): 2'-deoxy-2'-fluoro
  misc_feature (11)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
guaucaaaccaggccagcuuu

SEQ ID NO: 1586 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(5): 2'-deoxy-2'-fluoro
  misc_feature (6)..(8): 2'-deoxy
  misc_feature (9)..(10): 2'-deoxy-2'-fluoro
  misc_feature (11)..(11): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (21)..(21): inverted abasic cap
uggcugaaccaucacagautt

SEQ ID NO: 1587 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
aucugugaugguucagccauu

SEQ ID NO: 1588 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(13): 2'-deoxy-2'-fluoro
  misc_feature (14)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
cacccaccaucccacuggctt

SEQ ID NO: 1589 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
gccagugggaugguggguguu

SEQ ID NO: 1590 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(4): 2'-deoxy-2'-fluoro
  misc_feature (5)..(6): 2'-deoxy
  misc_feature (7)..(9): 2'-deoxy-2'-fluoro
  misc_feature (10)..(13): 2'-deoxy
  misc_feature (14)..(14): 2'-deoxy-2'-fluoro
  misc_feature (15)..(18): 2'-deoxy
  misc_feature (19)..(19): 2'-deoxy-2'-fluoro
  misc_feature (21)..(21): inverted abasic cap
caauggcuuggaaugagactt

SEQ ID NO: 1591 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(10): 2'-deoxy-2'-fluoro
  misc_feature (11)..(13): 2'-O-methyl
  misc_feature (14)..(15): 2'-deoxy-2'-fluoro
  misc_feature (16)..(16): 2'-O-methyl
  misc_feature (17)..(18): 2'-deoxy-2'-fluoro
  misc_feature (19)..(21): 2'-O-methyl
gucucauuccaagccauuguu

SEQ ID NO: 1592 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(6): 2'-deoxy-2'-fluoro
  misc_feature (7)..(7): 2'-deoxy
  misc_feature (8)..(8): 2'-deoxy-2'-fluoro
  misc_feature (9)..(11): 2'-deoxy
  misc_feature (12)..(12): 2'-deoxy-2'-fluoro
  misc_feature (13)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
uggaccacaagcagagugctt

SEQ ID NO: 1593 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(13): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
gcacucugcuugugguccauu

SEQ ID NO: 1594 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
ccauuccauuguuugugcatt

SEQ ID NO: 1595 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(16): 2'-O-methyl
  misc_feature (17)..(17): 2'-deoxy-2'-fluoro
  misc_feature (18)..(21): 2'-O-methyl
ugcacaaacaauggaaugguu

SEQ ID NO: 1596 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(5): 2'-deoxy
  misc_feature (6)..(9): 2'-deoxy-2'-fluoro
  misc_feature (10)..(10): 2'-deoxy
  misc_feature (11)..(11): 2'-deoxy-2'-fluoro
  misc_feature (12)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (21)..(21): inverted abasic cap
caggaccucauggaugggctt

SEQ ID NO: 1597 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (15)..(18): 2'-deoxy-2'-fluoro
  misc_feature (19)..(21): 2'-O-methyl
gcccauccaugagguccuguu

SEQ ID NO: 1598 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(5): 2'-deoxy
  misc_feature (6)..(8): 2'-deoxy-2'-fluoro
  misc_feature (9)..(9): 2'-deoxy
  misc_feature (10)..(12): 2'-deoxy-2'-fluoro
  misc_feature (13)..(16): 2'-deoxy
  misc_feature (17)..(17): 2'-deoxy-2'-fluoro
  misc_feature (18)..(19): 2'-deoxy
  misc_feature (21)..(21): inverted abasic cap
gugaacuugcucaggacaatt

SEQ ID NO: 1599 - RNA, 21 nt, Artificial Sequence
  Synthetic
  misc_feature (4)..(7): 2'-deoxy-2'-fluoro
  misc_feature (8)..(10): 2'-O-methyl
  misc_feature (11)..(11): 2'-deoxy-2'-fluoro
  misc_feature (12)..(13): 2'-O-methyl
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
uuguccugagcaaguucacuu

SEQ ID NO: 1600 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(10): 2'-deoxy-2'-fluoro
  misc_feature (11)..(11): 2'-deoxy
  misc_feature (12)..(12): 2'-deoxy-2'-fluoro
  misc_feature (13)..(15): 2'-deoxy
  misc_feature (16)..(16): 2'-deoxy-2'-fluoro
  misc_feature (17)..(19): 2'-deoxy
  misc_feature (21)..(21): inverted abasic cap
ccaggaccucauggaugggtt

SEQ ID NO: 1601 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (10)..(13): 2'-O-methyl
  misc_feature (14)..(17): 2'-deoxy-2'-fluoro
  misc_feature (18)..(21): 2'-O-methyl
cccauccaugagguccugguu

SEQ ID NO: 1602 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(4): 2'-deoxy-2'-fluoro
  misc_feature (5)..(7): 2'-deoxy
  misc_feature (8)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): inverted abasic cap
ggcugaaccaucacagaugtt

SEQ ID NO: 1603 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (13)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
caucugugaugguucagccuu

SEQ ID NO: 1604 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(6): 2'-deoxy-2'-fluoro
  misc_feature (7)..(8): 2'-deoxy
  misc_feature (9)..(10): 2'-deoxy-2'-fluoro
  misc_feature (11)..(11): 2'-deoxy
  misc_feature (12)..(14): 2'-deoxy-2'-fluoro
  misc_feature (15)..(16): 2'-deoxy
  misc_feature (17)..(18): 2'-deoxy-2'-fluoro
  misc_feature (19)..(19): 2'-deoxy
  misc_feature (21)..(21): inverted abasic cap
ggugcugacuauccaguugtt

SEQ ID NO: 1605 - RNA, 21 nt, Artificial Sequence
  Synthetic
  misc_feature (4)..(5): 2'-deoxy-2'-fluoro
  misc_feature (6)..(8): 2'-O-methyl
  misc_feature (9)..(9): 2'-deoxy-2'-fluoro
  misc_feature (10)..(11): 2'-O-methyl
  misc_feature (12)..(13): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
caacuggauagucagcaccuu

SEQ ID NO: 1606 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(7): 2'-deoxy-2'-fluoro
  misc_feature (8)..(11): 2'-deoxy
  misc_feature (12)..(12): 2'-deoxy-2'-fluoro
  misc_feature (13)..(16): 2'-deoxy
  misc_feature (17)..(18): 2'-deoxy-2'-fluoro
  misc_feature (19)..(19): 2'-deoxy
  misc_feature (21)..(21): inverted abasic cap
auggcuuggaaugagacugtt

SEQ ID NO: 1607 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(12): 2'-deoxy-2'-fluoro
  misc_feature (13)..(13): 2'-O-methyl
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
cagucucauuccaagccauuu

SEQ ID NO: 1608 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(7): 2'-deoxy
  misc_feature (8)..(8): 2'-deoxy-2'-fluoro
  misc_feature (9)..(9): 2'-deoxy
  misc_feature (10)..(11): 2'-deoxy-2'-fluoro
  misc_feature (12)..(12): 2'-deoxy
  misc_feature (13)..(14): 2'-deoxy-2'-fluoro
  misc_feature (15)..(17): 2'-deoxy
  misc_feature (18)..(19): 2'-deoxy-2'-fluoro
  misc_feature (21)..(21): inverted abasic cap
gggaagacaucacugagcctt

SEQ ID NO: 1609 - RNA, 21 nt, Artificial Sequence
  Synthetic
  misc_feature (4)..(5): 2'-deoxy-2'-fluoro
  misc_feature (6)..(7): 2'-O-methyl
  misc_feature (8)..(8): 2'-deoxy-2'-fluoro
  misc_feature (9)..(10): 2'-O-methyl
  misc_feature (11)..(11): 2'-deoxy-2'-fluoro
  misc_feature (12)..(12): 2'-O-methyl
  misc_feature (13)..(19): 2'-deoxy-2'-fluoro
  misc_feature (20)..(21): 2'-O-methyl
ggcucagugaugucuucccuu

SEQ ID NO: 1610 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(4): 2'-deoxy-2'-fluoro
  misc_feature (5)..(6): 2'-deoxy
  misc_feature (7)..(7): 2'-deoxy-2'-fluoro
  misc_feature (8)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
uggugacagggaagacauctt

SEQ ID NO: 1611 - RNA, 21 nt, Artificial Sequence
  Synthetic
  misc_feature (4)..(4): 2'-O-methyl
  misc_feature (5)..(12): 2'-deoxy-2'-fluoro
  misc_feature (13)..(13): 2'-O-methyl
  misc_feature (14)..(15): 2'-deoxy-2'-fluoro
  misc_feature (16)..(16): 2'-O-methyl
  misc_feature (17)..(18): 2'-deoxy-2'-fluoro
  misc_feature (19)..(21): 2'-O-methyl
gaugucuucccugucaccauu

SEQ ID NO: 1612 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(10): 2'-deoxy-2'-fluoro
  misc_feature (11)..(11): 2'-deoxy
  misc_feature (12)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
ugcucaucccacuaauguctt

SEQ ID NO: 1613 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(9): 2'-deoxy-2'-fluoro
  misc_feature (10)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
gacauuagugggaugagcauu

SEQ ID NO: 1614 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(6): 2'-deoxy-2'-fluoro
  misc_feature (7)..(8): 2'-deoxy
  misc_feature (9)..(10): 2'-deoxy-2'-fluoro
  misc_feature (11)..(12): 2'-deoxy
  misc_feature (13)..(13): 2'-deoxy-2'-fluoro
  misc_feature (14)..(16): 2'-deoxy
  misc_feature (17)..(18): 2'-deoxy-2'-fluoro
  misc_feature (19)..(19): 2'-deoxy
  misc_feature (21)..(21): inverted abasic cap
cuauccaguugaugggcugtt

SEQ ID NO: 1615 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(9): 2'-deoxy-2'-fluoro
  misc_feature (10)..(11): 2'-O-methyl
  misc_feature (12)..(13): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
cagcccaucaacuggauaguu

SEQ ID NO: 1616 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(7): 2'-deoxy-2'-fluoro
  misc_feature (8)..(8): 2'-deoxy
  misc_feature (9)..(9): 2'-deoxy-2'-fluoro
  misc_feature (10)..(12): 2'-deoxy
  misc_feature (13)..(13): 2'-deoxy-2'-fluoro
  misc_feature (14)..(16): 2'-deoxy
  misc_feature (17)..(18): 2'-deoxy-2'-fluoro
  misc_feature (19)..(19): 2'-deoxy
  misc_feature (21)..(21): inverted abasic cap
ggaccucauggaugggcugtt

SEQ ID NO: 1617 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(16): 2'-O-methyl
  misc_feature (17)..(19): 2'-deoxy-2'-fluoro
  misc_feature (20)..(21): 2'-O-methyl
cagcccauccaugagguccuu

SEQ ID NO: 1618 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(6): 2'-deoxy-2'-fluoro
  misc_feature (7)..(8): 2'-deoxy
  misc_feature (9)..(13): 2'-deoxy-2'-fluoro
  misc_feature (14)..(15): 2'-deoxy
  misc_feature (16)..(16): 2'-deoxy-2'-fluoro
  misc_feature (17)..(19): 2'-deoxy
  misc_feature (21)..(21): inverted abasic cap
cccacuggccucugauaaatt

SEQ ID NO: 1619 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(11): 2'-O-methyl
  misc_feature (12)..(13): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
uuuaucagaggccaguggguu

SEQ ID NO: 1620 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(11): 2'-deoxy-2'-fluoro
  misc_feature (12)..(16): 2'-deoxy
  misc_feature (17)..(17): 2'-deoxy-2'-fluoro
  misc_feature (18)..(19): 2'-deoxy
  misc_feature (21)..(21): inverted abasic cap
uccgaaugucugaggacaatt

SEQ ID NO: 1621 - RNA, 21 nt, Artificial Sequence
  Synthetic
  misc_feature (4)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(21): 2'-O-methyl
uuguccucagacauucggauu

SEQ ID NO: 1622 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(6): 2'-deoxy-2'-fluoro
  misc_feature (7)..(10): 2'-deoxy
  misc_feature (11)..(11): 2'-deoxy-2'-fluoro
  misc_feature (12)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
uggcuuggaaugagacugctt

SEQ ID NO: 1623 - RNA, 21 nt, Artificial Sequence
  Synthetic
  misc_feature (4)..(4): 2'-O-methyl
  misc_feature (5)..(8): 2'-deoxy-2'-fluoro
  misc_feature (9)..(9): 2'-O-methyl
  misc_feature (10)..(13): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
gcagucucauuccaagccauu

SEQ ID NO: 1624 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
uucagaugauauaaaugugtt

SEQ ID NO: 1625 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(21): 2'-O-methyl
cacauuuauaucaucugaauu

SEQ ID NO: 1626 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(4): 2'-deoxy-2'-fluoro
  misc_feature (5)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(18): 2'-deoxy
  misc_feature (19)..(19): 2'-deoxy-2'-fluoro
  misc_feature (21)..(21): inverted abasic cap
ccacaagauuacaagaaactt

SEQ ID NO: 1627 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(15): 2'-deoxy-2'-fluoro
  misc_feature (16)..(16): 2'-O-methyl
  misc_feature (17)..(17): 2'-deoxy-2'-fluoro
  misc_feature (18)..(21): 2'-O-methyl
guuucuuguaaucuugugguu

SEQ ID NO: 1628 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(7): 2'-deoxy-2'-fluoro
  misc_feature (8)..(8): 2'-deoxy
  misc_feature (9)..(9): 2'-deoxy-2'-fluoro
  misc_feature (10)..(11): 2'-deoxy
  misc_feature (12)..(12): 2'-deoxy-2'-fluoro
  misc_feature (13)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
cucacuugcaauaauuauatt

SEQ ID NO: 1629 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-O-methyl
  misc_feature (16)..(16): 2'-deoxy-2'-fluoro
  misc_feature (17)..(21): 2'-O-methyl
uauaauuauugcaagugaguu

SEQ ID NO: 1630 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (21)..(21): inverted abasic cap
cacuugcaauaauuauaagtt

SEQ ID NO: 1631 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
cuuauaauuauugcaaguguu

SEQ ID NO: 1632 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-deoxy
  misc_feature (4)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (21)..(21): inverted abasic cap
guaccaugcagaauacaaatt

SEQ ID NO: 1633 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
uuuguauucugcaugguacuu

SEQ ID NO: 1634 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(10): 2'-deoxy-2'-fluoro
  misc_feature (11)..(11): 2'-deoxy
  misc_feature (12)..(14): 2'-deoxy-2'-fluoro
  misc_feature (15)..(18): 2'-deoxy
  misc_feature (19)..(19): 2'-deoxy-2'-fluoro
  misc_feature (21)..(21): inverted abasic cap
ucaacgucuuguucagaactt

SEQ ID NO: 1635 - RNA, 21 nt, Artificial Sequence
  Synthetic
  misc_feature (4)..(5): 2'-deoxy-2'-fluoro
  misc_feature (6)..(8): 2'-O-methyl
  misc_feature (9)..(9): 2'-deoxy-2'-fluoro
  misc_feature (10)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(21): 2'-O-methyl
guucugaacaagacguugauu

SEQ ID NO: 1636 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(5): 2'-deoxy-2'-fluoro
  misc_feature (6)..(6): 2'-deoxy
  misc_feature (7)..(9): 2'-deoxy-2'-fluoro
  misc_feature (10)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(18): 2'-deoxy-2'-fluoro
  misc_feature (19)..(19): 2'-deoxy
  misc_feature (21)..(21): inverted abasic cap
aucccaucuacacaguuugtt

SEQ ID NO: 1637 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (20)..(21): 2'-O-methyl
caaacuguguagaugggauuu

SEQ ID NO: 1638 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(8): 2'-deoxy
  misc_feature (9)..(10): 2'-deoxy-2'-fluoro
  misc_feature (11)..(12): 2'-deoxy
  misc_feature (13)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (21)..(21): inverted abasic cap
uacucaagcugauuugaugtt

SEQ ID NO: 1639 - RNA, 21 nt, Artificial Sequence
  Synthetic
  misc_feature (4)..(4): 2'-deoxy-2'-fluoro
  misc_feature (5)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
caucaaaucagcuugaguauu

SEQ ID NO: 1640 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(12): 2'-deoxy
  misc_feature (13)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (21)..(21): inverted abasic cap
accagguggugguuaauaatt

SEQ ID NO: 1641 - RNA, 21 nt, Artificial Sequence
  Synthetic
  misc_feature (4)..(5): 2'-deoxy-2'-fluoro
  misc_feature (6)..(7): 2'-O-methyl
  misc_feature (8)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
uuauuaaccaccaccugguuu

SEQ ID NO: 1642 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(7): 2'-deoxy
  misc_feature (8)..(9): 2'-deoxy-2'-fluoro
  misc_feature (10)..(12): 2'-deoxy
  misc_feature (13)..(13): 2'-deoxy-2'-fluoro
  misc_feature (14)..(19): 2'-deoxy
  misc_feature (21)..(21): inverted abasic cap
gcugcaacuaaacaggaagtt

SEQ ID NO: 1643 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
cuuccuguuuaguugcagcuu

SEQ ID NO: 1644 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(6): 2'-deoxy-2'-fluoro
  misc_feature (7)..(8): 2'-deoxy
  misc_feature (9)..(11): 2'-deoxy-2'-fluoro
  misc_feature (12)..(15): 2'-deoxy
  misc_feature (16)..(19): 2'-deoxy-2'-fluoro
  misc_feature (21)..(21): inverted abasic cap
uggauugauucgaaaucuutt

SEQ ID NO: 1645 - RNA, 21 nt, Artificial Sequence
  Synthetic
  misc_feature (4)..(4): 2'-O-methyl
  misc_feature (5)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
aagauuucgaaucaauccauu

SEQ ID NO: 1646 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
cagaugauauaaauguggutt

SEQ ID NO: 1647 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
accacauuuauaucaucuguu

SEQ ID NO: 1648 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
auggugucugcuauuguactt

SEQ ID NO: 1649 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
guacaauagcagacaccauuu

SEQ ID NO: 1650 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(7): 2'-deoxy
  misc_feature (8)..(9): 2'-deoxy-2'-fluoro
  misc_feature (10)..(10): 2'-deoxy
  misc_feature (11)..(11): 2'-deoxy-2'-fluoro
  misc_feature (12)..(17): 2'-deoxy
  misc_feature (18)..(18): 2'-deoxy-2'-fluoro
  misc_feature (19)..(19): 2'-deoxy
  misc_feature (21)..(21): inverted abasic cap
cacaagauuacaagaaacgtt

SEQ ID NO: 1651 - RNA, 21 nt, Artificial Sequence
  Synthetic
  misc_feature (4)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (13)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
cguuucuuguaaucuuguguu

SEQ ID NO: 1652 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
caaaugauguagaaacagctt

SEQ ID NO: 1653 - RNA, 21 nt, Artificial Sequence
  Synthetic
  misc_feature (4)..(4): 2'-O-methyl
  misc_feature (5)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
gcuguuucuacaucauuuguu

SEQ ID NO: 1654 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(9): 2'-deoxy
  misc_feature (10)..(11): 2'-deoxy-2'-fluoro
  misc_feature (12)..(12): 2'-deoxy
  misc_feature (13)..(13): 2'-deoxy-2'-fluoro
  misc_feature (14)..(19): 2'-deoxy
  misc_feature (21)..(21): inverted abasic cap
gccacaagauuacaagaaatt

SEQ ID NO: 1655 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(10): 2'-O-methyl
  misc_feature (11)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
uuucuuguaaucuuguggcuu

SEQ ID NO: 1656 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(17): 2'-deoxy
  misc_feature (18)..(18): 2'-deoxy-2'-fluoro
  misc_feature (19)..(19): 2'-deoxy
  misc_feature (21)..(21): inverted abasic cap
uacaaaugauguagaaacatt

SEQ ID NO: 1657 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
uguuucuacaucauuuguauu

SEQ ID NO: 1658 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(10): 2'-deoxy-2'-fluoro
  misc_feature (11)..(11): 2'-deoxy
  misc_feature (12)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
ucgaaaucuugcccuuugutt

SEQ ID NO: 1659 - RNA, 21 nt, Artificial Sequence
  Synthetic
  misc_feature (4)..(8): 2'-O-methyl
  misc_feature (9)..(9): 2'-deoxy-2'-fluoro
  misc_feature (10)..(13): 2'-O-methyl
  misc_feature (14)..(17): 2'-deoxy-2'-fluoro
  misc_feature (18)..(21): 2'-O-methyl
acaaagggcaagauuucgauu

SEQ ID NO: 1660 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(4): 2'-deoxy-2'-fluoro
  misc_feature (5)..(6): 2'-deoxy
  misc_feature (7)..(8): 2'-deoxy-2'-fluoro
  misc_feature (9)..(9): 2'-deoxy
  misc_feature (10)..(11): 2'-deoxy-2'-fluoro
  misc_feature (12)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
gauuaacuaucaagaugautt

SEQ ID NO: 1661 - RNA, 21 nt, Artificial Sequence
  Synthetic
  misc_feature (4)..(4): 2'-O-methyl
  misc_feature (5)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
aucaucuugauaguuaaucuu

SEQ ID NO: 1662 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(4): 2'-deoxy
  misc_feature (5)..(5): 2'-deoxy-2'-fluoro
  misc_feature (6)..(8): 2'-deoxy
  misc_feature (9)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
ccaguggauucuguguugutt

SEQ ID NO: 1663 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(11): 2'-O-methyl
  misc_feature (12)..(14): 2'-deoxy-2'-fluoro
  misc_feature (15)..(15): 2'-O-methyl
  misc_feature (16)..(17): 2'-deoxy-2'-fluoro
  misc_feature (18)..(21): 2'-O-methyl
acaacacagaauccacugguu

SEQ ID NO: 1664 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(13): 2'-deoxy-2'-fluoro
  misc_feature (14)..(16): 2'-deoxy
  misc_feature (17)..(18): 2'-deoxy-2'-fluoro
  misc_feature (19)..(19): 2'-deoxy
  misc_feature (21)..(21): inverted abasic cap
aaaggcuacuguuggauugtt

SEQ ID NO: 1665 - RNA, 21 nt, Artificial Sequence
  Synthetic
  misc_feature (4)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(19): 2'-deoxy-2'-fluoro
  misc_feature (20)..(21): 2'-O-methyl
caauccaacaguagccuuuuu

SEQ ID NO: 1666 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(5): 2'-deoxy
  misc_feature (6)..(6): 2'-deoxy-2'-fluoro
  misc_feature (7)..(8): 2'-deoxy
  misc_feature (9)..(10): 2'-deoxy-2'-fluoro
  misc_feature (11)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
acaaguagcugauauugautt

SEQ ID NO: 1667 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(9): 2'-deoxy-2'-fluoro
  misc_feature (10)..(11): 2'-O-methyl
  misc_feature (12)..(13): 2'-deoxy-2'-fluoro
  misc_feature (15)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aucaauaucagcuacuuguuu

SEQ ID NO: 1668 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(14): 2'-deoxy
  misc_feature (15)..(15): 2'-deoxy-2'-fluoro
  misc_feature (16)..(18): 2'-deoxy
  misc_feature (19)..(19): 2'-deoxy-2'-fluoro
  misc_feature (21)..(21): inverted abasic cap
gauggaacaugagaugggutt

SEQ ID NO: 1669 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
acccaucucauguuccaucuu

SEQ ID NO: 1670 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(16): 2'-deoxy
  misc_feature (17)..(19): 2'-deoxy-2'-fluoro
  misc_feature (21)..(21): inverted abasic cap
ucaagaugaugcagaacuutt

SEQ ID NO: 1671 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
aaguucugcaucaucuugauu

SEQ ID NO: 1672 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(6): 2'-deoxy-2'-fluoro
  misc_feature (7)..(8): 2'-deoxy
  misc_feature (9)..(11): 2'-deoxy-2'-fluoro
  misc_feature (12)..(13): 2'-deoxy
  misc_feature (14)..(14): 2'-deoxy-2'-fluoro
  misc_feature (15)..(18): 2'-deoxy
  misc_feature (19)..(19): 2'-deoxy-2'-fluoro
  misc_feature (21)..(21): inverted abasic cap
caagcugauuugauggagutt

SEQ ID NO: 1673 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
acuccaucaaaucagcuuguu

SEQ ID NO: 1674 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(9): 2'-deoxy-2'-fluoro
  misc_feature (10)..(14): 2'-deoxy
  misc_feature (15)..(19): 2'-deoxy-2'-fluoro
  misc_feature (21)..(21): inverted abasic cap
uggacucucaggaaucuuutt

SEQ ID NO: 1675 - RNA, 21 nt, Artificial Sequence
  Synthetic
  misc_feature (4)..(5): 2'-O-methyl
  misc_feature (6)..(10): 2'-deoxy-2'-fluoro
  misc_feature (11)..(13): 2'-O-methyl
  misc_feature (15)..(15): 2'-O-methyl
  misc_feature (16)..(18): 2'-deoxy-2'-fluoro
  misc_feature (19)..(21): 2'-O-methyl
aaagauuccugagaguccauu

SEQ ID NO: 1676 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
uaaauaccauuccauuguutt

SEQ ID NO: 1677 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
aacaauggaaugguauuuauu

SEQ ID NO: 1678 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(17): 2'-deoxy
  misc_feature (18)..(19): 2'-deoxy-2'-fluoro
  misc_feature (21)..(21): inverted abasic cap
auuacaucaagaaggagcutt

SEQ ID NO: 1679 - RNA, 21 nt, Artificial Sequence
  Synthetic
  misc_feature (4)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
agcuccuucuugauguaauuu

SEQ ID NO: 1680 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(7): 2'-deoxy
  misc_feature (8)..(13): 2'-deoxy-2'-fluoro
  misc_feature (14)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
ucaggaaucuuucagaugctt

SEQ ID NO: 1681 - RNA, 21 nt, Artificial Sequence
  Synthetic
  misc_feature (4)..(6): 2'-deoxy-2'-fluoro
  misc_feature (7)..(12): 2'-O-methyl
  misc_feature (13)..(17): 2'-deoxy-2'-fluoro
  misc_feature (18)..(21): 2'-O-methyl
gcaucugaaagauuccugauu

SEQ ID NO: 1682 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(5): 2'-deoxy-2'-fluoro
  misc_feature (6)..(7): 2'-deoxy
  misc_feature (8)..(9): 2'-deoxy-2'-fluoro
  misc_feature (10)..(10): 2'-deoxy
  misc_feature (11)..(12): 2'-deoxy-2'-fluoro
  misc_feature (13)..(16): 2'-deoxy
  misc_feature (17)..(17): 2'-deoxy-2'-fluoro
  misc_feature (18)..(19): 2'-deoxy
  misc_feature (21)..(21): inverted abasic cap
ugauuaacuaucaagaugatt

SEQ ID NO: 1683 - RNA, 21 nt, Artificial Sequence
  Synthetic
  misc_feature (4)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (13)..(14): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
ucaucuugauaguuaaucauu

SEQ ID NO: 1684 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(5): 2'-deoxy-2'-fluoro
  misc_feature (6)..(6): 2'-deoxy
  misc_feature (7)..(10): 2'-deoxy-2'-fluoro
  misc_feature (11)..(15): 2'-deoxy
  misc_feature (16)..(16): 2'-deoxy-2'-fluoro
  misc_feature (17)..(19): 2'-deoxy
  misc_feature (21)..(21): inverted abasic cap
acuucacucuaggaaugaatt

SEQ ID NO: 1685 - RNA, 21 nt, Artificial Sequence
  Synthetic
  misc_feature (4)..(4): 2'-O-methyl
  misc_feature (5)..(9): 2'-deoxy-2'-fluoro
  misc_feature (10)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (20)..(21): 2'-O-methyl
uucauuccuagagugaaguuu

SEQ ID NO: 1686 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(9): 2'-deoxy
  misc_feature (10)..(11): 2'-deoxy-2'-fluoro
  misc_feature (12)..(12): 2'-deoxy
  misc_feature (13)..(13): 2'-deoxy-2'-fluoro
  misc_feature (14)..(16): 2'-deoxy
  misc_feature (17)..(19): 2'-deoxy-2'-fluoro
  misc_feature (21)..(21): inverted abasic cap
aacaugcaguuguaaacuutt

SEQ ID NO: 1687 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
aaguuuacaacugcauguuuu

SEQ ID NO: 1688 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(5): 2'-deoxy-2'-fluoro
  misc_feature (6)..(7): 2'-deoxy
  misc_feature (8)..(10): 2'-deoxy-2'-fluoro
  misc_feature (11)..(12): 2'-deoxy
  misc_feature (13)..(13): 2'-deoxy-2'-fluoro
  misc_feature (14)..(17): 2'-deoxy
  misc_feature (18)..(19): 2'-deoxy-2'-fluoro
  misc_feature (21)..(21): inverted abasic cap
aagcugauuugauggaguutt

SEQ ID NO: 1689 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(9): 2'-deoxy-2'-fluoro
  misc_feature (10)..(12): 2'-O-methyl
  misc_feature (13)..(14): 2'-deoxy-2'-fluoro
  misc_feature (15)..(16): 2'-O-methyl
  misc_feature (17)..(19): 2'-deoxy-2'-fluoro
  misc_feature (20)..(21): 2'-O-methyl
aacuccaucaaaucagcuuuu

SEQ ID NO: 1690 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(9): 2'-deoxy-2'-fluoro
  misc_feature (10)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
ucuggguucagaugauauatt

SEQ ID NO: 1691 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(10): 2'-deoxy-2'-fluoro
  misc_feature (11)..(13): 2'-O-methyl
  misc_feature (14)..(16): 2'-deoxy-2'-fluoro
  misc_feature (17)..(21): 2'-O-methyl
uauaucaucugaacccagauu

SEQ ID NO: 1692 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-deoxy
  misc_feature (4)..(7): 2'-deoxy-2'-fluoro
  misc_feature (8)..(8): 2'-deoxy
  misc_feature (9)..(12): 2'-deoxy-2'-fluoro
  misc_feature (13)..(17): 2'-deoxy
  misc_feature (18)..(18): 2'-deoxy-2'-fluoro
  misc_feature (19)..(19): 2'-deoxy
  misc_feature (21)..(21): inverted abasic cap
uuacuucacucuaggaaugtt

SEQ ID NO: 1693 - RNA, 21 nt, Artificial Sequence
  Synthetic
  misc_feature (4)..(7): 2'-deoxy-2'-fluoro
  misc_feature (8)..(11): 2'-O-methyl
  misc_feature (12)..(12): 2'-deoxy-2'-fluoro
  misc_feature (13)..(13): 2'-O-methyl
  misc_feature (15)..(16): 2'-O-methyl
  misc_feature (17)..(17): 2'-deoxy-2'-fluoro
  misc_feature (18)..(21): 2'-O-methyl
cauuccuagagugaaguaauu

SEQ ID NO: 1694 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(5): 2'-deoxy
  misc_feature (6)..(11): 2'-deoxy-2'-fluoro
  misc_feature (12)..(14): 2'-deoxy
  misc_feature (15)..(15): 2'-deoxy-2'-fluoro
  misc_feature (16)..(16): 2'-deoxy
  misc_feature (17)..(18): 2'-deoxy-2'-fluoro
  misc_feature (19)..(19): 2'-deoxy
  misc_feature (21)..(21): inverted abasic cap
aggaaucuuucagaugcugtt

SEQ ID NO: 1695 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (9)..(13): 2'-O-methyl
  misc_feature (15)..(19): 2'-deoxy-2'-fluoro
  misc_feature (20)..(21): 2'-O-methyl
cagcaucugaaagauuccuuu

SEQ ID NO: 1696 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
gcugaaacaugcaguuguatt

SEQ ID NO: 1697 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
uacaacugcauguuucagcuu

SEQ ID NO: 1698 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(7): 2'-deoxy-2'-fluoro
  misc_feature (8)..(8): 2'-deoxy
  misc_feature (9)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
guugcuuguucgugcacautt

SEQ ID NO: 1699 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
augugcacgaacaagcaacuu

SEQ ID NO: 1700 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(8): 2'-deoxy
  misc_feature (9)..(9): 2'-deoxy-2'-fluoro
  misc_feature (10)..(11): 2'-deoxy
  misc_feature (12)..(13): 2'-deoxy-2'-fluoro
  misc_feature (14)..(18): 2'-deoxy
  misc_feature (19)..(19): 2'-deoxy-2'-fluoro
  misc_feature (21)..(21): inverted abasic cap
ggaagaaauaguugaaggutt

SEQ ID NO: 1701 - RNA, 21 nt, Artificial Sequence
  Synthetic
  misc_feature (4)..(6): 2'-deoxy-2'-fluoro
  misc_feature (7)..(8): 2'-O-methyl
  misc_feature (9)..(10): 2'-deoxy-2'-fluoro
  misc_feature (11)..(11): 2'-O-methyl
  misc_feature (12)..(19): 2'-deoxy-2'-fluoro
  misc_feature (20)..(21): 2'-O-methyl
accuucaacuauuucuuccuu

SEQ ID NO: 1702 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(5): 2'-deoxy-2'-fluoro
  misc_feature (6)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(16): 2'-deoxy
  misc_feature (17)..(18): 2'-deoxy-2'-fluoro
  misc_feature (19)..(19): 2'-deoxy
  misc_feature (21)..(21): inverted abasic cap
aggacaagccacaagauuatt

SEQ ID NO: 1703 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(14): 2'-deoxy-2'-fluoro
  misc_feature (15)..(15): 2'-O-methyl
  misc_feature (16)..(19): 2'-deoxy-2'-fluoro
  misc_feature (20)..(21): 2'-O-methyl
uaaucuuguggcuuguccuuu

SEQ ID NO: 1704 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): inverted abasic cap
caugcguucuccucagaugtt

SEQ ID NO: 1705 - RNA, 21 nt, Artificial Sequence
  Synthetic
  misc_feature (4)..(5): 2'-deoxy-2'-fluoro
  misc_feature (6)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
caucugaggagaacgcauguu

SEQ ID NO: 1706 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(5): 2'-deoxy
  misc_feature (6)..(9): 2'-deoxy-2'-fluoro
  misc_feature (10)..(11): 2'-deoxy
  misc_feature (12)..(13): 2'-deoxy-2'-fluoro
  misc_feature (14)..(14): 2'-deoxy
  misc_feature (15)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
gaugaucccagcuaccguutt

SEQ ID NO: 1707 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(8): 2'-O-methyl
  misc_feature (9)..(10): 2'-deoxy-2'-fluoro
  misc_feature (11)..(13): 2'-O-methyl
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
aacgguagcugggaucaucuu

SEQ ID NO: 1708 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(19): 2'-deoxy-2'-fluoro
  misc_feature (21)..(21): inverted abasic cap
agccugccaucugugcucutt

SEQ ID NO: 1709 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
agagcacagauggcaggcuuu

SEQ ID NO: 1710 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(11): 2'-deoxy-2'-fluoro
  misc_feature (12)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
uggauaucgccaggaugautt

SEQ ID NO: 1711 - RNA, 21 nt, Artificial Sequence
  Synthetic
  misc_feature (4)..(4): 2'-O-methyl
  misc_feature (5)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
aucauccuggcgauauccauu

SEQ ID NO: 1712 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(12): 2'-deoxy-2'-fluoro
  misc_feature (13)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
ucuucgucaucugaccagctt

SEQ ID NO: 1713 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(21): 2'-O-methyl
gcuggucagaugacgaagauu

SEQ ID NO: 1714 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(9): 2'-deoxy-2'-fluoro
  misc_feature (10)..(10): 2'-deoxy
  misc_feature (11)..(13): 2'-deoxy-2'-fluoro
  misc_feature (14)..(17): 2'-deoxy
  misc_feature (18)..(18): 2'-deoxy-2'-fluoro
  misc_feature (19)..(19): 2'-deoxy
  misc_feature (21)..(21): inverted abasic cap
ugugaacuugcucaggacatt

SEQ ID NO: 1715 - RNA, 21 nt, Artificial Sequence
  Synthetic
  misc_feature (4)..(6): 2'-deoxy-2'-fluoro
  misc_feature (7)..(9): 2'-O-methyl
  misc_feature (10)..(10): 2'-deoxy-2'-fluoro
  misc_feature (11)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
uguccugagcaaguucacauu

SEQ ID NO: 1716 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(9): 2'-deoxy
  misc_feature (10)..(11): 2'-deoxy-2'-fluoro
  misc_feature (12)..(15): 2'-deoxy
  misc_feature (16)..(19): 2'-deoxy-2'-fluoro
  misc_feature (21)..(21): inverted abasic cap
ccugugcagcuggaauucutt

SEQ ID NO: 1717 - RNA, 21 nt, Artificial Sequence
  Synthetic
  misc_feature (4)..(4): 2'-O-methyl
  misc_feature (5)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
agaauuccagcugcacagguu

SEQ ID NO: 1718 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(7): 2'-deoxy-2'-fluoro
  misc_feature (8)..(8): 2'-deoxy
  misc_feature (9)..(11): 2'-deoxy-2'-fluoro
  misc_feature (12)..(15): 2'-deoxy
  misc_feature (16)..(16): 2'-deoxy-2'-fluoro
  misc_feature (17)..(19): 2'-deoxy
  misc_feature (21)..(21): inverted abasic cap
ugaacuugcucaggacaagtt

SEQ ID NO: 1719 - RNA, 21 nt, Artificial Sequence
  Synthetic
  misc_feature (4)..(4): 2'-O-methyl
  misc_feature (5)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (15)..(15): 2'-O-methyl
  misc_feature (16)..(18): 2'-deoxy-2'-fluoro
  misc_feature (19)..(21): 2'-O-methyl
cuuguccugagcaaguucauu

SEQ ID NO: 1720 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(6): 2'-deoxy
  misc_feature (7)..(8): 2'-deoxy-2'-fluoro
  misc_feature (9)..(9): 2'-deoxy
  misc_feature (10)..(12): 2'-deoxy-2'-fluoro
  misc_feature (13)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
ugcugacuauccaguugautt

SEQ ID NO: 1721 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(10): 2'-O-methyl
  misc_feature (11)..(11): 2'-deoxy-2'-fluoro
  misc_feature (12)..(13): 2'-O-methyl
  misc_feature (14)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
aucaacuggauagucagcauu

SEQ ID NO: 1722 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(18): 2'-deoxy-2'-fluoro
  misc_feature (19)..(19): 2'-deoxy
  misc_feature (21)..(21): inverted abasic cap
gaugauauaaauguggucatt

SEQ ID NO: 1723 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(11): 2'-deoxy-2'-fluoro
  misc_feature (12)..(12): 2'-O-methyl
  misc_feature (13)..(13): 2'-deoxy-2'-fluoro
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
ugaccacauuuauaucaucuu

SEQ ID NO: 1724 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-deoxy
  misc_feature (4)..(5): 2'-deoxy-2'-fluoro
  misc_feature (6)..(7): 2'-deoxy
  misc_feature (8)..(9): 2'-deoxy-2'-fluoro
  misc_feature (10)..(10): 2'-deoxy
  misc_feature (11)..(13): 2'-deoxy-2'-fluoro
  misc_feature (14)..(15): 2'-deoxy
  misc_feature (16)..(17): 2'-deoxy-2'-fluoro
  misc_feature (18)..(19): 2'-deoxy
  misc_feature (21)..(21): inverted abasic cap
gugcugacuauccaguugatt

SEQ ID NO: 1725 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(9): 2'-O-methyl
  misc_feature (10)..(10): 2'-deoxy-2'-fluoro
  misc_feature (11)..(12): 2'-O-methyl
  misc_feature (13)..(14): 2'-deoxy-2'-fluoro
  misc_feature (15)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
ucaacuggauagucagcacuu

SEQ ID NO: 1726 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(5): 2'-deoxy-2'-fluoro
  misc_feature (6)..(6): 2'-deoxy
  misc_feature (7)..(9): 2'-deoxy-2'-fluoro
  misc_feature (10)..(11): 2'-deoxy
  misc_feature (12)..(13): 2'-deoxy-2'-fluoro
  misc_feature (14)..(15): 2'-deoxy
  misc_feature (16)..(16): 2'-deoxy-2'-fluoro
  misc_feature (17)..(19): 2'-deoxy
  misc_feature (21)..(21): inverted abasic cap
ugacuauccaguugaugggtt

SEQ ID NO: 1727 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(10): 2'-deoxy-2'-fluoro
  misc_feature (11)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
cccaucaacuggauagucauu

SEQ ID NO: 1728 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(5): 2'-deoxy-2'-fluoro
  misc_feature (6)..(6): 2'-deoxy
  misc_feature (7)..(9): 2'-deoxy-2'-fluoro
  misc_feature (10)..(13): 2'-deoxy
  misc_feature (14)..(14): 2'-deoxy-2'-fluoro
  misc_feature (15)..(19): 2'-deoxy
  misc_feature (21)..(21): inverted abasic cap
aacuugcucaggacaaggatt

SEQ ID NO: 1729 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(10): 2'-deoxy-2'-fluoro
  misc_feature (11)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
uccuuguccugagcaaguuuu

SEQ ID NO: 1730 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(4): 2'-deoxy
  misc_feature (5)..(6): 2'-deoxy-2'-fluoro
  misc_feature (7)..(7): 2'-deoxy
  misc_feature (8)..(10): 2'-deoxy-2'-fluoro
  misc_feature (11)..(12): 2'-deoxy
  misc_feature (13)..(14): 2'-deoxy-2'-fluoro
  misc_feature (15)..(16): 2'-deoxy
  misc_feature (17)..(17): 2'-deoxy-2'-fluoro
  misc_feature (18)..(19): 2'-deoxy
  misc_feature (21)..(21): inverted abasic cap
cugacuauccaguugauggtt

SEQ ID NO: 1731 - RNA, 21 nt, Artificial Sequence
  Synthetic
  misc_feature (4)..(5): 2'-deoxy-2'-fluoro
  misc_feature (6)..(7): 2'-O-methyl
  misc_feature (8)..(9): 2'-deoxy-2'-fluoro
  misc_feature (10)..(12): 2'-O-methyl
  misc_feature (13)..(13): 2'-deoxy-2'-fluoro
  misc_feature (15)..(15): 2'-O-methyl
  misc_feature (16)..(17): 2'-deoxy-2'-fluoro
  misc_feature (18)..(21): 2'-O-methyl
ccaucaacuggauagucaguu

SEQ ID NO: 1732 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(4): 2'-deoxy-2'-fluoro
  misc_feature (5)..(5): 2'-deoxy
  misc_feature (6)..(9): 2'-deoxy-2'-fluoro
  misc_feature (10)..(10): 2'-deoxy
  misc_feature (11)..(12): 2'-deoxy-2'-fluoro
  misc_feature (13)..(14): 2'-deoxy
  misc_feature (15)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
gcucaucccacuaaugucctt

SEQ ID NO: 1733 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(9): 2'-O-methyl
  misc_feature (10)..(10): 2'-deoxy-2'-fluoro
  misc_feature (11)..(13): 2'-O-methyl
  misc_feature (15)..(15): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
ggacauuagugggaugagcuu

SEQ ID NO: 1734 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(5): 2'-deoxy
  misc_feature (6)..(7): 2'-deoxy-2'-fluoro
  misc_feature (8)..(8): 2'-deoxy
  misc_feature (9)..(11): 2'-deoxy-2'-fluoro
  misc_feature (12)..(13): 2'-deoxy
  misc_feature (14)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (21)..(21): inverted abasic cap
gcugacuauccaguugaugtt

SEQ ID NO: 1735 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (15)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
caucaacuggauagucagcuu

SEQ ID NO: 1736 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(10): 2'-deoxy
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
augauauaaauguggucactt

SEQ ID NO: 1737 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (9)..(9): 2'-O-methyl
  misc_feature (10)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
gugaccacauuuauaucauuu

SEQ ID NO: 1738 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(8): 2'-deoxy-2'-fluoro
  misc_feature (9)..(9): 2'-deoxy
  misc_feature (10)..(11): 2'-deoxy-2'-fluoro
  misc_feature (12)..(13): 2'-deoxy
  misc_feature (14)..(14): 2'-deoxy-2'-fluoro
  misc_feature (15)..(15): 2'-deoxy
  misc_feature (16)..(18): 2'-deoxy-2'-fluoro
  misc_feature (19)..(19): 2'-deoxy
  misc_feature (21)..(21): inverted abasic cap
cucaucccacuaauguccatt

SEQ ID NO: 1739 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(8): 2'-deoxy-2'-fluoro
  misc_feature (9)..(10): 2'-O-methyl
  misc_feature (11)..(11): 2'-deoxy-2'-fluoro
  misc_feature (12)..(13): 2'-O-methyl
  misc_feature (15)..(15): 2'-O-methyl
  misc_feature (16)..(16): 2'-deoxy-2'-fluoro
  misc_feature (17)..(21): 2'-O-methyl
uggacauuagugggaugaguu

SEQ ID NO: 1740 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(5): 2'-deoxy-2'-fluoro
  misc_feature (6)..(6): 2'-deoxy
  misc_feature (7)..(13): 2'-deoxy-2'-fluoro
  misc_feature (14)..(14): 2'-deoxy
  misc_feature (15)..(16): 2'-deoxy-2'-fluoro
  misc_feature (17)..(19): 2'-deoxy
  misc_feature (21)..(21): inverted abasic cap
gcuuuauucucccauugaatt

SEQ ID NO: 1741 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(13): 2'-O-methyl
  misc_feature (14)..(14): 2'-deoxy-2'-fluoro
  misc_feature (15)..(18): 2'-O-methyl
  misc_feature (19)..(19): 2'-deoxy-2'-fluoro
  misc_feature (20)..(21): 2'-O-methyl
uucaaugggagaauaaagcuu

SEQ ID NO: 1742 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (9)..(10): 2'-deoxy
  misc_feature (11)..(12): 2'-deoxy-2'-fluoro
  misc_feature (13)..(13): 2'-deoxy
  misc_feature (14)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
cuggugcugacuauccagutt

SEQ ID NO: 1743 - RNA, 21 nt, Artificial Sequence
  Synthetic
  misc_feature (4)..(6): 2'-O-methyl
  misc_feature (7)..(7): 2'-deoxy-2'-fluoro
  misc_feature (8)..(9): 2'-O-methyl
  misc_feature (10)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-O-methyl
  misc_feature (16)..(17): 2'-deoxy-2'-fluoro
  misc_feature (18)..(21): 2'-O-methyl
acuggauagucagcaccaguu

SEQ ID NO: 1744 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(4): 2'-deoxy-2'-fluoro
  misc_feature (5)..(5): 2'-deoxy
  misc_feature (6)..(10): 2'-deoxy-2'-fluoro
  misc_feature (11)..(13): 2'-deoxy
  misc_feature (14)..(18): 2'-deoxy-2'-fluoro
  misc_feature (19)..(19): 2'-deoxy
  misc_feature (21)..(21): inverted abasic cap
aacugucuuuggacucucatt

SEQ ID NO: 1745 - RNA, 21 nt, Artificial Sequence
  Synthetic
  misc_feature (4)..(6): 2'-O-methyl
  misc_feature (7)..(9): 2'-deoxy-2'-fluoro
  misc_feature (10)..(13): 2'-O-methyl
  misc_feature (15)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
ugagaguccaaagacaguuuu

SEQ ID NO: 1746 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(12): 2'-deoxy
  misc_feature (13)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
agggcaugcagaucccauctt

SEQ ID NO: 1747 - RNA, 21 nt, Artificial Sequence
  Synthetic
  misc_feature (4)..(7): 2'-O-methyl
  misc_feature (8)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (20)..(21): 2'-O-methyl
gaugggaucugcaugcccuuu

SEQ ID NO: 1748 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
gauauaaauguggucaccutt

SEQ ID NO: 1749 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
aggugaccacauuuauaucuu

SEQ ID NO: 1750 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(16): 2'-deoxy-2'-fluoro
  misc_feature (17)..(19): 2'-deoxy
  misc_feature (21)..(21): inverted abasic cap
uucagaugcugcaacuaaatt

SEQ ID NO: 1751 - RNA, 21 nt, Artificial Sequence
  Synthetic
  misc_feature (4)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(21): 2'-O-methyl
uuuaguugcagcaucugaauu

SEQ ID NO: 1752 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(6): 2'-deoxy
  misc_feature (7)..(7): 2'-deoxy-2'-fluoro
  misc_feature (8)..(9): 2'-deoxy
  misc_feature (10)..(11): 2'-deoxy-2'-fluoro
  misc_feature (12)..(16): 2'-deoxy
  misc_feature (17)..(18): 2'-deoxy-2'-fluoro
  misc_feature (19)..(19): 2'-deoxy
  misc_feature (21)..(21): inverted abasic cap
aagaaauaguugaagguugtt

SEQ ID NO: 1753 - RNA, 21 nt, Artificial Sequence
  Synthetic
  misc_feature (4)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (14)..(19): 2'-deoxy-2'-fluoro
  misc_feature (20)..(21): 2'-O-methyl
caaccuucaacuauuucuuuu

SEQ ID NO: 1754 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(7): 2'-deoxy-2'-fluoro
  misc_feature (8)..(9): 2'-deoxy
  misc_feature (10)..(13): 2'-deoxy-2'-fluoro
  misc_feature (14)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
ccaggaugauccuagcuautt

SEQ ID NO: 1755 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
auagcuaggaucauccugguu

SEQ ID NO: 1756 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(5): 2'-deoxy-2'-fluoro
  misc_feature (6)..(6): 2'-deoxy
  misc_feature (7)..(11): 2'-deoxy-2'-fluoro
  misc_feature (12)..(14): 2'-deoxy
  misc_feature (15)..(17): 2'-deoxy-2'-fluoro
  misc_feature (18)..(19): 2'-deoxy
  misc_feature (21)..(21): inverted abasic cap
uggccaucuuuaagucuggtt

SEQ ID NO: 1757 - RNA, 21 nt, Artificial Sequence
  Synthetic
  misc_feature (4)..(5): 2'-O-methyl
  misc_feature (6)..(8): 2'-deoxy-2'-fluoro
  misc_feature (9)..(13): 2'-O-methyl
  misc_feature (14)..(14): 2'-deoxy-2'-fluoro
  misc_feature (15)..(16): 2'-O-methyl
  misc_feature (17)..(18): 2'-deoxy-2'-fluoro
  misc_feature (19)..(21): 2'-O-methyl
ccagacuuaaagauggccauu

SEQ ID NO: 1758 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(4): 2'-deoxy-2'-fluoro
  misc_feature (5)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(12): 2'-deoxy
  misc_feature (13)..(13): 2'-deoxy-2'-fluoro
  misc_feature (14)..(16): 2'-deoxy
  misc_feature (17)..(17): 2'-deoxy-2'-fluoro
  misc_feature (18)..(19): 2'-deoxy
  misc_feature (21)..(21): inverted abasic cap
agcugauauugauggacagtt

SEQ ID NO: 1759 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
cuguccaucaauaucagcuuu

SEQ ID NO: 1760 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(7): 2'-deoxy-2'-fluoro
  misc_feature (8)..(8): 2'-deoxy
  misc_feature (9)..(11): 2'-deoxy-2'-fluoro
  misc_feature (12)..(12): 2'-deoxy
  misc_feature (13)..(13): 2'-deoxy-2'-fluoro
  misc_feature (14)..(15): 2'-deoxy
  misc_feature (16)..(17): 2'-deoxy-2'-fluoro
  misc_feature (18)..(19): 2'-deoxy
  misc_feature (21)..(21): inverted abasic cap
ucgggauguucacaaccgatt

SEQ ID NO: 1761 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): 2'-deoxy-2'-fluoro
  misc_feature (9)..(11): 2'-O-methyl
  misc_feature (12)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
ucgguugugaacaucccgauu

SEQ ID NO: 1762 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(8): 2'-deoxy
  misc_feature (9)..(10): 2'-deoxy-2'-fluoro
  misc_feature (11)..(12): 2'-deoxy
  misc_feature (13)..(13): 2'-deoxy-2'-fluoro
  misc_feature (14)..(17): 2'-deoxy
  misc_feature (18)..(18): 2'-deoxy-2'-fluoro
  misc_feature (19)..(19): 2'-deoxy
  misc_feature (21)..(21): inverted abasic cap
uguagaagcugguggaaugtt

SEQ ID NO: 1763 - RNA, 21 nt, Artificial Sequence
  Synthetic
  misc_feature (4)..(6): 2'-deoxy-2'-fluoro
  misc_feature (7)..(7): 2'-O-methyl
  misc_feature (8)..(9): 2'-deoxy-2'-fluoro
  misc_feature (10)..(11): 2'-O-methyl
  misc_feature (12)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
cauuccaccagcuucuacauu

SEQ ID NO: 1764 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(15): 2'-deoxy
  misc_feature (16)..(18): 2'-deoxy-2'-fluoro
  misc_feature (19)..(19): 2'-deoxy
  misc_feature (21)..(21): inverted abasic cap
uaaauauaaugaggaccuatt

SEQ ID NO: 1765 - RNA, 21 nt, Artificial Sequence
  Synthetic
  misc_feature (4)..(4): 2'-O-methyl
  misc_feature (5)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
uagguccucauuauauuuauu

SEQ ID NO: 1766 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(13): 2'-deoxy
  misc_feature (14)..(14): 2'-deoxy-2'-fluoro
  misc_feature (15)..(19): 2'-deoxy
  misc_feature (21)..(21): inverted abasic cap
cugagacauuagaugagggtt

SEQ ID NO: 1767 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
cccucaucuaaugucucaguu

SEQ ID NO: 1768 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(11): 2'-deoxy
  misc_feature (12)..(12): 2'-deoxy-2'-fluoro
  misc_feature (13)..(17): 2'-deoxy
  misc_feature (18)..(19): 2'-deoxy-2'-fluoro
  misc_feature (21)..(21): inverted abasic cap
aguaaauauaaugaggacctt

SEQ ID NO: 1769 - RNA, 21 nt, Artificial Sequence
  Synthetic
  misc_feature (4)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
gguccucauuauauuuacuuu

SEQ ID NO: 1770 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(6): 2'-deoxy
  misc_feature (7)..(12): 2'-deoxy-2'-fluoro
  misc_feature (13)..(15): 2'-deoxy
  misc_feature (16)..(19): 2'-deoxy-2'-fluoro
  misc_feature (21)..(21): inverted abasic cap
uggauaccucccaaguccutt

SEQ ID NO: 1771 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(13): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
aggacuugggagguauccauu

SEQ ID NO: 1772 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(5): 2'-deoxy-2'-fluoro
  misc_feature (6)..(6): 2'-deoxy
  misc_feature (7)..(10): 2'-deoxy-2'-fluoro
  misc_feature (11)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (21)..(21): inverted abasic cap
aggaugccuuggguauggatt

SEQ ID NO: 1773 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (10)..(13): 2'-O-methyl
  misc_feature (14)..(14): 2'-deoxy-2'-fluoro
  misc_feature (15)..(15): 2'-O-methyl
  misc_feature (16)..(19): 2'-deoxy-2'-fluoro
  misc_feature (20)..(21): 2'-O-methyl
uccauacccaaggcauccuuu

SEQ ID NO: 1774 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(19): 2'-deoxy
  misc_feature (21)..(21): inverted abasic cap
auuguacguaccaugcagatt

SEQ ID NO: 1775 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
ucugcaugguacguacaauuu

SEQ ID NO: 1776 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(11): 2'-deoxy-2'-fluoro
  misc_feature (12)..(16): 2'-deoxy
  misc_feature (17)..(19): 2'-deoxy-2'-fluoro
  misc_feature (21)..(21): inverted abasic cap
uuuggacucucaggaaucutt

SEQ ID NO: 1777 - RNA, 21 nt, Artificial Sequence
  Synthetic
  misc_feature (4)..(8): 2'-deoxy-2'-fluoro
  misc_feature (9)..(13): 2'-O-methyl
  misc_feature (14)..(16): 2'-deoxy-2'-fluoro
  misc_feature (17)..(21): 2'-O-methyl
agauuccugagaguccaaauu

SEQ ID NO: 1778 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(5): 2'-deoxy
  misc_feature (6)..(7): 2'-deoxy-2'-fluoro
  misc_feature (8)..(9): 2'-deoxy
  misc_feature (10)..(12): 2'-deoxy-2'-fluoro
  misc_feature (13)..(16): 2'-deoxy
  misc_feature (17)..(19): 2'-deoxy-2'-fluoro
  misc_feature (21)..(21): inverted abasic cap
uuggauugauucgaaaucutt

SEQ ID NO: 1779 - RNA, 21 nt, Artificial Sequence
  Synthetic
  misc_feature (4)..(7): 2'-deoxy-2'-fluoro
  misc_feature (8)..(10): 2'-O-methyl
  misc_feature (11)..(12): 2'-deoxy-2'-fluoro
  misc_feature (13)..(13): 2'-O-methyl
  misc_feature (15)..(17): 2'-deoxy-2'-fluoro
  misc_feature (18)..(21): 2'-O-methyl
agauuucgaaucaauccaauu

SEQ ID NO: 1780 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(8): 2'-deoxy
  misc_feature (9)..(10): 2'-deoxy-2'-fluoro
  misc_feature (11)..(13): 2'-deoxy
  misc_feature (14)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
ucagaggacuaaauaccautt

SEQ ID NO: 1781 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (10)..(11): 2'-O-methyl
  misc_feature (12)..(17): 2'-deoxy-2'-fluoro
  misc_feature (18)..(21): 2'-O-methyl
augguauuuaguccucugauu

SEQ ID NO: 1782 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(7): 2'-deoxy-2'-fluoro
  misc_feature (8)..(8): 2'-deoxy
  misc_feature (9)..(12): 2'-deoxy-2'-fluoro
  misc_feature (13)..(15): 2'-deoxy
  misc_feature (16)..(16): 2'-deoxy-2'-fluoro
  misc_feature (17)..(17): 2'-deoxy
  misc_feature (18)..(18): 2'-deoxy-2'-fluoro
  misc_feature (19)..(19): 2'-deoxy
  misc_feature (21)..(21): inverted abasic cap
ccaggaugccuuggguaugtt

SEQ ID NO: 1783 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(11): 2'-O-methyl
  misc_feature (12)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
cauacccaaggcauccugguu

SEQ ID NO: 1784 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): inverted abasic cap
auggaacaugagaugggugtt

SEQ ID NO: 1785 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
cacccaucucauguuccauuu

SEQ ID NO: 1786 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(4): 2'-deoxy-2'-fluoro
  misc_feature (5)..(5): 2'-deoxy
  misc_feature (6)..(7): 2'-deoxy-2'-fluoro
  misc_feature (8)..(8): 2'-deoxy
  misc_feature (9)..(10): 2'-deoxy-2'-fluoro
  misc_feature (11)..(13): 2'-deoxy
  misc_feature (14)..(15): 2'-deoxy-2'-fluoro
  misc_feature (16)..(17): 2'-deoxy
  misc_feature (18)..(19): 2'-deoxy-2'-fluoro
  misc_feature (21)..(21): inverted abasic cap
ggcuacuguuggauugauutt

SEQ ID NO: 1787 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
aaucaauccaacaguagccuu

SEQ ID NO: 1788 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(8): 2'-deoxy-2'-fluoro
  misc_feature (9)..(9): 2'-deoxy
  misc_feature (10)..(10): 2'-deoxy-2'-fluoro
  misc_feature (11)..(13): 2'-deoxy
  misc_feature (14)..(14): 2'-deoxy-2'-fluoro
  misc_feature (15)..(17): 2'-deoxy
  misc_feature (18)..(19): 2'-deoxy-2'-fluoro
  misc_feature (21)..(21): inverted abasic cap
aggaccucauggaugggcutt

SEQ ID NO: 1789 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (15)..(15): 2'-O-methyl
  misc_feature (16)..(19): 2'-deoxy-2'-fluoro
  misc_feature (20)..(21): 2'-O-methyl
agcccauccaugagguccuuu

SEQ ID NO: 1790 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(12): 2'-deoxy-2'-fluoro
  misc_feature (13)..(13): 2'-deoxy
  misc_feature (14)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
ucugugcucuucgucaucutt

SEQ ID NO: 1791 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
agaugacgaagagcacagauu

SEQ ID NO: 1792 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(3): 2'-deoxy
  misc_feature (4)..(4): 2'-deoxy-2'-fluoro
  misc_feature (5)..(8): 2'-deoxy
  misc_feature (9)..(10): 2'-deoxy-2'-fluoro
  misc_feature (11)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
ugauggaguuggacauggctt

SEQ ID NO: 1793 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (10)..(11): 2'-O-methyl
  misc_feature (12)..(15): 2'-deoxy-2'-fluoro
  misc_feature (16)..(16): 2'-O-methyl
  misc_feature (17)..(18): 2'-deoxy-2'-fluoro
  misc_feature (19)..(21): 2'-O-methyl
gccauguccaacuccaucauu

SEQ ID NO: 1794 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(15): 2'-deoxy
  misc_feature (16)..(19): 2'-deoxy-2'-fluoro
  misc_feature (21)..(21): inverted abasic cap
augagggcaugcagauccctt

SEQ ID NO: 1795 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
gggaucugcaugcccucauuu

SEQ ID NO: 1796 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(7): 2'-deoxy-2'-fluoro
  misc_feature (8)..(9): 2'-deoxy
  misc_feature (10)..(11): 2'-deoxy-2'-fluoro
  misc_feature (12)..(13): 2'-deoxy
  misc_feature (14)..(14): 2'-deoxy-2'-fluoro
  misc_feature (15)..(17): 2'-deoxy
  misc_feature (18)..(19): 2'-deoxy-2'-fluoro
  misc_feature (21)..(21): inverted abasic cap
acuauccaguugaugggcutt

SEQ ID NO: 1797 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(8): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
agcccaucaacuggauaguuu

SEQ ID NO: 1798 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(6): 2'-deoxy
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(14): 2'-deoxy
  misc_feature (15)..(18): 2'-deoxy-2'-fluoro
  misc_feature (19)..(19): 2'-deoxy
  misc_feature (21)..(21): inverted abasic cap
ugagggcaugcagaucccatt

SEQ ID NO: 1799 - RNA, 21 nt, Artificial Sequence
  Synthetic
  misc_feature (4)..(5): 2'-O-methyl
  misc_feature (6)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (14)..(18): 2'-deoxy-2'-fluoro
  misc_feature (19)..(21): 2'-O-methyl
ugggaucugcaugcccucauu

SEQ ID NO: 1800 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(5): 2'-deoxy
  misc_feature (6)..(6): 2'-deoxy-2'-fluoro
  misc_feature (7)..(7): 2'-deoxy
  misc_feature (8)..(9): 2'-deoxy-2'-fluoro
  misc_feature (10)..(10): 2'-deoxy
  misc_feature (11)..(12): 2'-deoxy-2'-fluoro
  misc_feature (13)..(16): 2'-deoxy
  misc_feature (17)..(17): 2'-deoxy-2'-fluoro
  misc_feature (18)..(19): 2'-deoxy
  misc_feature (21)..(21): inverted abasic cap
uuggauaucgccaggaugatt

SEQ ID NO: 1801 - RNA, 21 nt, Artificial Sequence
  Synthetic
  misc_feature (4)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (13)..(13): 2'-deoxy-2'-fluoro
  misc_feature (15)..(17): 2'-deoxy-2'-fluoro
  misc_feature (18)..(21): 2'-O-methyl
ucauccuggcgauauccaauu

SEQ ID NO: 1802 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(4): 2'-deoxy-2'-fluoro
  misc_feature (5)..(8): 2'-deoxy
  misc_feature (9)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): inverted abasic cap
gcccaggaccucauggaugtt

SEQ ID NO: 1803 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(11): 2'-O-methyl
  misc_feature (12)..(15): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
cauccaugagguccugggcuu

SEQ ID NO: 1804 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(5): 2'-deoxy-2'-fluoro
  misc_feature (6)..(6): 2'-deoxy
  misc_feature (7)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
aacuugccacacgugcaautt

SEQ ID NO: 1805 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
auugcacguguggcaaguuuu

SEQ ID NO: 1806 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (21)..(21): inverted abasic cap
cccaaguccuguaugagugtt

SEQ ID NO: 1807 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(13): 2'-O-methyl
  misc_feature (14)..(16): 2'-deoxy-2'-fluoro
  misc_feature (17)..(21): 2'-O-methyl
cacucauacaggacuuggguu

SEQ ID NO: 1808 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(14): 2'-deoxy
  misc_feature (15)..(15): 2'-deoxy-2'-fluoro
  misc_feature (16)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
cacagaugcugaaacaugctt

SEQ ID NO: 1809 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
gcauguuucagcaucuguguu

SEQ ID NO: 1810 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-deoxy
  misc_feature (7)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(19): 2'-deoxy-2'-fluoro
  misc_feature (21)..(21): inverted abasic cap
cugggaccuugcauaaccutt

SEQ ID NO: 1811 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(13): 2'-O-methyl
  misc_feature (14)..(17): 2'-deoxy-2'-fluoro
  misc_feature (18)..(21): 2'-O-methyl
agguuaugcaaggucccaguu

SEQ ID NO: 1812 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(6): 2'-deoxy
  misc_feature (7)..(10): 2'-deoxy-2'-fluoro
  misc_feature (11)..(11): 2'-deoxy
  misc_feature (12)..(12): 2'-deoxy-2'-fluoro
  misc_feature (13)..(13): 2'-deoxy
  misc_feature (14)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
aguggauucuguguuguuutt

SEQ ID NO: 1813 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(13): 2'-O-methyl
  misc_feature (14)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
aaacaacacagaauccacuuu

SEQ ID NO: 1814 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-deoxy-2'-fluoro
  misc_feature (6)..(8): 2'-deoxy
  misc_feature (9)..(12): 2'-deoxy-2'-fluoro
  misc_feature (13)..(16): 2'-deoxy
  misc_feature (17)..(19): 2'-deoxy-2'-fluoro
  misc_feature (21)..(21): inverted abasic cap
aaugcaagcuuuaggacuutt

SEQ ID NO: 1815 - RNA, 21 nt, Artificial Sequence
  Synthetic
  misc_feature (4)..(7): 2'-deoxy-2'-fluoro
  misc_feature (8)..(11): 2'-O-methyl
  misc_feature (12)..(14): 2'-deoxy-2'-fluoro
  misc_feature (15)..(15): 2'-O-methyl
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
aaguccuaaagcuugcauuuu

SEQ ID NO: 1816 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(5): 2'-deoxy
  misc_feature (6)..(6): 2'-deoxy-2'-fluoro
  misc_feature (7)..(8): 2'-deoxy
  misc_feature (9)..(10): 2'-deoxy-2'-fluoro
  misc_feature (11)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
agaaauaguugaagguugutt

SEQ ID NO: 1817 - RNA, 21 nt, Artificial Sequence
  Synthetic
  misc_feature (4)..(4): 2'-O-methyl
  misc_feature (5)..(9): 2'-deoxy-2'-fluoro
  misc_feature (10)..(11): 2'-O-methyl
  misc_feature (12)..(13): 2'-deoxy-2'-fluoro
  misc_feature (15)..(19): 2'-deoxy-2'-fluoro
  misc_feature (20)..(21): 2'-O-methyl
acaaccuucaacuauuucuuu

SEQ ID NO: 1818 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(7): 2'-deoxy-2'-fluoro
  misc_feature (8)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
uccgcauggaagaaauagutt

SEQ ID NO: 1819 - RNA, 21 nt, Artificial Sequence
  Synthetic
  misc_feature (4)..(4): 2'-O-methyl
  misc_feature (5)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
acuauuucuuccaugcggauu

SEQ ID NO: 1820 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-deoxy
  misc_feature (5)..(5): 2'-deoxy-2'-fluoro
  misc_feature (6)..(6): 2'-deoxy
  misc_feature (7)..(12): 2'-deoxy-2'-fluoro
  misc_feature (13)..(16): 2'-deoxy
  misc_feature (17)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
gcuauguucccugagacautt

SEQ ID NO: 1821 - RNA, 21 nt, Artificial Sequence
  Synthetic
  misc_feature (4)..(7): 2'-deoxy-2'-fluoro
  misc_feature (8)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
augucucagggaacauagcuu

SEQ ID NO: 1822 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(15): 2'-deoxy
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
ucugagugguaaaggcaautt

SEQ ID NO: 1823 - RNA, 21 nt, Artificial Sequence
  Synthetic
  misc_feature (4)..(4): 2'-O-methyl
  misc_feature (5)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(21): 2'-O-methyl
auugccuuuaccacucagauu

SEQ ID NO: 1824 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (4)..(6): 2'-deoxy
  misc_feature (7)..(10): 2'-deoxy-2'-fluoro
  misc_feature (11)..(14): 2'-deoxy
  misc_feature (15)..(18): 2'-deoxy-2'-fluoro
  misc_feature (19)..(19): 2'-deoxy
  misc_feature (21)..(21): inverted abasic cap
ugcaagcuuuaggacuucatt

SEQ ID NO: 1825 - RNA, 21 nt, Artificial Sequence
  Synthetic
  misc_feature (4)..(5): 2'-O-methyl
  misc_feature (6)..(9): 2'-deoxy-2'-fluoro
  misc_feature (10)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (19)..(21): 2'-O-methyl
ugaaguccuaaagcuugcauu

SEQ ID NO: 1826 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(4): 2'-deoxy
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-deoxy
  misc_feature (12)..(12): 2'-deoxy-2'-fluoro
  misc_feature (13)..(14): 2'-deoxy
  misc_feature (15)..(15): 2'-deoxy-2'-fluoro
  misc_feature (16)..(17): 2'-deoxy
  misc_feature (18)..(19): 2'-deoxy-2'-fluoro
  misc_feature (21)..(21): inverted abasic cap
uggacaguaugcaaugacutt

SEQ ID NO: 1827 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
agucauugcauacuguccauu

SEQ ID NO: 1828 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-deoxy
  misc_feature (11)..(11): 2'-deoxy-2'-fluoro
  misc_feature (12)..(13): 2'-deoxy
  misc_feature (14)..(14): 2'-deoxy-2'-fluoro
  misc_feature (15)..(19): 2'-deoxy
  misc_feature (21)..(21): inverted abasic cap
uuaguaaauauaaugaggatt

SEQ ID NO: 1829 - RNA, 21 nt, Artificial Sequence
  Synthetic
  misc_feature (4)..(5): 2'-deoxy-2'-fluoro
  misc_feature (6)..(6): 2'-O-methyl
  misc_feature (7)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(14): 2'-deoxy-2'-fluoro
  misc_feature (15)..(15): 2'-O-methyl
  misc_feature (16)..(17): 2'-deoxy-2'-fluoro
  misc_feature (18)..(21): 2'-O-methyl
uccucauuauauuuacuaauu

SEQ ID NO: 1830 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(7): 2'-deoxy-2'-fluoro
  misc_feature (8)..(9): 2'-deoxy
  misc_feature (10)..(10): 2'-deoxy-2'-fluoro
  misc_feature (11)..(11): 2'-deoxy
  misc_feature (12)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
cucagauggugucugcuautt

SEQ ID NO: 1831 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(8): 2'-O-methyl
  misc_feature (9)..(9): 2'-deoxy-2'-fluoro
  misc_feature (10)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(21): 2'-O-methyl
auagcagacaccaucugaguu

SEQ ID NO: 1832 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(11): 2'-deoxy
  misc_feature (12)..(13): 2'-deoxy-2'-fluoro
  misc_feature (14)..(15): 2'-deoxy
  misc_feature (16)..(16): 2'-deoxy-2'-fluoro
  misc_feature (17)..(17): 2'-deoxy
  misc_feature (18)..(19): 2'-deoxy-2'-fluoro
  misc_feature (21)..(21): inverted abasic cap
agaacaaguagcugauauutt

SEQ ID NO: 1833 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(10): 2'-deoxy-2'-fluoro
  misc_feature (11)..(11): 2'-O-methyl
  misc_feature (12)..(14): 2'-deoxy-2'-fluoro
  misc_feature (15)..(15): 2'-O-methyl
  misc_feature (16)..(19): 2'-deoxy-2'-fluoro
  misc_feature (20)..(21): 2'-O-methyl
aauaucagcuacuuguucuuu

SEQ ID NO: 1834 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy-2'-fluoro
  misc_feature (4)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(11): 2'-deoxy
  misc_feature (12)..(13): 2'-deoxy-2'-fluoro
  misc_feature (14)..(17): 2'-deoxy
  misc_feature (18)..(18): 2'-deoxy-2'-fluoro
  misc_feature (19)..(19): 2'-deoxy
  misc_feature (21)..(21): inverted abasic cap
cuuggauaucgccaggaugtt

SEQ ID NO: 1835 - RNA, 21 nt, Artificial Sequence
  Synthetic
  misc_feature (4)..(6): 2'-deoxy-2'-fluoro
  misc_feature (7)..(8): 2'-O-methyl
  misc_feature (9)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(16): 2'-deoxy-2'-fluoro
  misc_feature (17)..(21): 2'-O-methyl
cauccuggcgauauccaaguu

SEQ ID NO: 1836 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy-2'-fluoro
  misc_feature (2)..(2): 2'-deoxy
  misc_feature (3)..(5): 2'-deoxy-2'-fluoro
  misc_feature (6)..(6): 2'-deoxy
  misc_feature (7)..(7): 2'-deoxy-2'-fluoro
  misc_feature (8)..(8): 2'-deoxy
  misc_feature (9)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
caucugugcucuucgucautt

SEQ ID NO: 1837 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(11): 2'-O-methyl
  misc_feature (12)..(12): 2'-deoxy-2'-fluoro
  misc_feature (13)..(13): 2'-O-methyl
  misc_feature (14)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
augacgaagagcacagauguu

SEQ ID NO: 1838 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy-2'-fluoro
  misc_feature (5)..(6): 2'-deoxy
  misc_feature (7)..(7): 2'-deoxy-2'-fluoro
  misc_feature (8)..(8): 2'-deoxy
  misc_feature (9)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(18): 2'-deoxy-2'-fluoro
  misc_feature (19)..(19): 2'-deoxy
  misc_feature (21)..(21): inverted abasic cap
cccuggugcugacuauccatt

SEQ ID NO: 1839 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(11): 2'-O-methyl
  misc_feature (12)..(12): 2'-deoxy-2'-fluoro
  misc_feature (13)..(13): 2'-O-methyl
  misc_feature (14)..(15): 2'-deoxy-2'-fluoro
  misc_feature (16)..(21): 2'-O-methyl
uggauagucagcaccaggguu

SEQ ID NO: 1840 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(6): 2'-deoxy-2'-fluoro
  misc_feature (7)..(8): 2'-deoxy
  misc_feature (9)..(11): 2'-deoxy-2'-fluoro
  misc_feature (12)..(13): 2'-deoxy
  misc_feature (14)..(15): 2'-deoxy-2'-fluoro
  misc_feature (16)..(16): 2'-deoxy
  misc_feature (17)..(19): 2'-deoxy-2'-fluoro
  misc_feature (21)..(21): inverted abasic cap
acgacuaguucaguugcuutt

SEQ ID NO: 1841 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aagcaacugaacuagucguuu

SEQ ID NO: 1842 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(4): 2'-deoxy-2'-fluoro
  misc_feature (5)..(7): 2'-deoxy
  misc_feature (8)..(10): 2'-deoxy-2'-fluoro
  misc_feature (11)..(12): 2'-deoxy
  misc_feature (13)..(13): 2'-deoxy-2'-fluoro
  misc_feature (14)..(14): 2'-deoxy
  misc_feature (15)..(16): 2'-deoxy-2'-fluoro
  misc_feature (17)..(18): 2'-deoxy
  misc_feature (19)..(19): 2'-deoxy-2'-fluoro
  misc_feature (21)..(21): inverted abasic cap
ucuuggacuugauauuggutt

SEQ ID NO: 1843 - RNA, 21 nt, Artificial Sequence
  Synthetic
  misc_feature (4)..(5): 2'-O-methyl
  misc_feature (6)..(6): 2'-deoxy-2'-fluoro
  misc_feature (7)..(7): 2'-O-methyl
  misc_feature (8)..(9): 2'-deoxy-2'-fluoro
  misc_feature (10)..(12): 2'-O-methyl
  misc_feature (13)..(15): 2'-deoxy-2'-fluoro
  misc_feature (16)..(21): 2'-O-methyl
accaauaucaaguccaagauu

SEQ ID NO: 1844 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-deoxy
  misc_feature (4)..(4): 2'-deoxy-2'-fluoro
  misc_feature (5)..(6): 2'-deoxy
  misc_feature (7)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (21)..(21): inverted abasic cap
ggaugauccuagcuaucgutt

SEQ ID NO: 1845 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
acgauagcuaggaucauccuu

SEQ ID NO: 1846 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuaguaaauauaaugaggatt

SEQ ID NO: 1847 - RNA, 21 nt, Artificial Sequence
  Synthetic
  misc_feature (20)..(21): 2'-O-methyl
uccucauuauauuuacuaauu

SEQ ID NO: 1848 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaacuugcucaggacaagtt

SEQ ID NO: 1849 - RNA, 21 nt, Artificial Sequence
  Synthetic
  misc_feature (20)..(21): 2'-O-methyl
cuuguccugagcaaguucauu

SEQ ID NO: 1850 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucagauggugucugcuautt

SEQ ID NO: 1851 - RNA, 21 nt, Artificial Sequence
  Synthetic
  misc_feature (20)..(21): 2'-O-methyl
auagcagacaccaucugaguu

SEQ ID NO: 1852 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaacaaguagcugauauutt

SEQ ID NO: 1853 - RNA, 21 nt, Artificial Sequence
  Synthetic
  misc_feature (20)..(21): 2'-O-methyl
aauaucagcuacuuguucuuu

SEQ ID NO: 1854 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuuuauucucccauugaatt

SEQ ID NO: 1855 - RNA, 21 nt, Artificial Sequence
  Synthetic
  misc_feature (20)..(21): 2'-O-methyl
uucaaugggagaauaaagcuu

SEQ ID NO: 1856 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcugacuauccaguugautt

SEQ ID NO: 1857 - RNA, 21 nt, Artificial Sequence
  Synthetic
  misc_feature (20)..(21): 2'-O-methyl
aucaacuggauagucagcauu

SEQ ID NO: 1858 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuggauaucgccaggaugtt

SEQ ID NO: 1859 - RNA, 21 nt, Artificial Sequence
  Synthetic
  misc_feature (20)..(21): 2'-O-methyl
cauccuggcgauauccaaguu

SEQ ID NO: 1860 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caucugugcucuucgucautt

SEQ ID NO: 1861 - RNA, 21 nt, Artificial Sequence
  Synthetic
  misc_feature (20)..(21): 2'-O-methyl
augacgaagagcacagauguu

SEQ ID NO: 1862 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccuggugcugacuauccatt

SEQ ID NO: 1863 - RNA, 21 nt, Artificial Sequence
  Synthetic
  misc_feature (20)..(21): 2'-O-methyl
uggauagucagcaccaggguu

SEQ ID NO: 1864 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augauauaaauguggucactt

SEQ ID NO: 1865 - RNA, 21 nt, Artificial Sequence
  Synthetic
  misc_feature (20)..(21): 2'-O-methyl
gugaccacauuuauaucauuu

SEQ ID NO: 1866 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugacuauccaguugaugggtt

SEQ ID NO: 1867 - RNA, 21 nt, Artificial Sequence
  Synthetic
  misc_feature (20)..(21): 2'-O-methyl
cccaucaacuggauagucauu

SEQ ID NO: 1868 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccauuccauuguuugugcatt

SEQ ID NO: 1869 - RNA, 21 nt, Artificial Sequence
  Synthetic
  misc_feature (20)..(21): 2'-O-methyl
ugcacaaacaauggaaugguu

SEQ ID NO: 1870 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggauaucgccaggaugautt

SEQ ID NO: 1871 - RNA, 21 nt, Artificial Sequence
  Synthetic
  misc_feature (20)..(21): 2'-O-methyl
aucauccuggcgauauccauu

SEQ ID NO: 1872 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacugucuuuggacucucatt

SEQ ID NO: 1873 - RNA, 21 nt, Artificial Sequence
  Synthetic
  misc_feature (20)..(21): 2'-O-methyl
ugagaguccaaagacaguuuu

SEQ ID NO: 1874 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuguuggauugauucgaatt

SEQ ID NO: 1875 - RNA, 21 nt, Artificial Sequence
  Synthetic
  misc_feature (20)..(21): 2'-O-methyl
uucgaaucaauccaacaguuu

SEQ ID NO: 1876 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugacuauccaguugauggtt

SEQ ID NO: 1877 - RNA, 21 nt, Artificial Sequence
  Synthetic
  misc_feature (20)..(21): 2'-O-methyl
ccaucaacuggauagucaguu

SEQ ID NO: 1878 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuguuggauugauucgaaatt

SEQ ID NO: 1879 - RNA, 21 nt, Artificial Sequence
  Synthetic
  misc_feature (20)..(21): 2'-O-methyl
uuucgaaucaauccaacaguu

SEQ ID NO: 1880 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcugaaccaucacagaugtt

SEQ ID NO: 1881 - RNA, 21 nt, Artificial Sequence
  Synthetic
  misc_feature (20)..(21): 2'-O-methyl
caucugugaugguucagccuu

SEQ ID NO: 1882 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agggcaugcagaucccauctt

SEQ ID NO: 1883 - RNA, 21 nt, Artificial Sequence
  Synthetic
  misc_feature (20)..(21): 2'-O-methyl
gaugggaucugcaugcccuuu

SEQ ID NO: 1884 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcugacuauccaguugatt

SEQ ID NO: 1885 - RNA, 21 nt, Artificial Sequence
  Synthetic
  misc_feature (20)..(21): 2'-O-methyl
ucaacuggauagucagcacuu

SEQ ID NO: 1886 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauauaaauguggucaccutt

SEQ ID NO: 1887 - RNA, 21 nt, Artificial Sequence
  Synthetic
  misc_feature (20)..(21): 2'-O-methyl
aggugaccacauuuauaucuu

SEQ ID NO: 1888 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucagaugcugcaacuaaatt

SEQ ID NO: 1889 - RNA, 21 nt, Artificial Sequence
  Synthetic
  misc_feature (20)..(21): 2'-O-methyl
uuuaguugcagcaucugaauu

SEQ ID NO: 1890 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagaaauaguugaagguugtt

SEQ ID NO: 1891 - RNA, 21 nt, Artificial Sequence
  Synthetic
  misc_feature (20)..(21): 2'-O-methyl
caaccuucaacuauuucuuuu

SEQ ID NO: 1892 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaagaugaugcagaacuutt

SEQ ID NO: 1893 - RNA, 21 nt, Artificial Sequence
  Synthetic
  misc_feature (20)..(21): 2'-O-methyl
aaguucugcaucaucuugauu

SEQ ID NO: 1894 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaggaugauccuagcuautt

SEQ ID NO: 1895 - RNA, 21 nt, Artificial Sequence
  Synthetic
  misc_feature (20)..(21): 2'-O-methyl
auagcuaggaucauccugguu

SEQ ID NO: 1896 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggacaagccacaagauuatt

SEQ ID NO: 1897 - RNA, 21 nt, Artificial Sequence
  Synthetic
  misc_feature (20)..(21): 2'-O-methyl
uaaucuuguggcuuguccuuu

SEQ ID NO: 1898 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggccaucuuuaagucuggtt

SEQ ID NO: 1899 - RNA, 21 nt, Artificial Sequence
  Synthetic
  misc_feature (20)..(21): 2'-O-methyl
ccagacuuaaagauggccauu

SEQ ID NO: 1900 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuucacucuaggaaugaatt

SEQ ID NO: 1901 - RNA, 21 nt, Artificial Sequence
  Synthetic
  misc_feature (20)..(21): 2'-O-methyl
uucauuccuagagugaaguuu

SEQ ID NO: 1902 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcugauauugauggacagtt

SEQ ID NO: 1903 - RNA, 21 nt, Artificial Sequence
  Synthetic
  misc_feature (20)..(21): 2'-O-methyl
cuguccaucaauaucagcuuu

SEQ ID NO: 1904 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucgggauguucacaaccgatt

SEQ ID NO: 1905 - RNA, 21 nt, Artificial Sequence
  Synthetic
  misc_feature (20)..(21): 2'-O-methyl
ucgguugugaacaucccgauu

SEQ ID NO: 1906 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguagaagcugguggaaugtt

SEQ ID NO: 1907 - RNA, 21 nt, Artificial Sequence
  Synthetic
  misc_feature (20)..(21): 2'-O-methyl
cauuccaccagcuucuacauu

SEQ ID NO: 1908 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaauauaaugaggaccuatt

SEQ ID NO: 1909 - RNA, 21 nt, Artificial Sequence
  Synthetic
  misc_feature (20)..(21): 2'-O-methyl
uagguccucauuauauuuauu

SEQ ID NO: 1910 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaaguagcugauauugautt

SEQ ID NO: 1911 - RNA, 21 nt, Artificial Sequence
  Synthetic
  misc_feature (20)..(21): 2'-O-methyl
aucaauaucagcuacuuguuu

SEQ ID NO: 1912 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acgacuaguucaguugcuutt

SEQ ID NO: 1913 - RNA, 21 nt, Artificial Sequence
  Synthetic
  misc_feature (20)..(21): 2'-O-methyl
aagcaacugaacuagucguuu

SEQ ID NO: 1914 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuuggacuugauauuggutt

SEQ ID NO: 1915 - RNA, 21 nt, Artificial Sequence
  Synthetic
  misc_feature (20)..(21): 2'-O-methyl
accaauaucaaguccaagauu

SEQ ID NO: 1916 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaugauccuagcuaucgutt

SEQ ID NO: 1917 - RNA, 21 nt, Artificial Sequence
  Synthetic
  misc_feature (20)..(21): 2'-O-methyl
acgauagcuaggaucauccuu

SEQ ID NO: 1918 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauacaaaugauguagaaatt

SEQ ID NO: 1919 - RNA, 21 nt, Artificial Sequence
  Synthetic
  misc_feature (20)..(21): 2'-O-methyl
uuucuacaucauuuguauuuu

SEQ ID NO: 1920 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaauaccauuccauuguutt

SEQ ID NO: 1921 - RNA, 21 nt, Artificial Sequence
  Synthetic
  misc_feature (20)..(21): 2'-O-methyl
aacaauggaaugguauuuauu

SEQ ID NO: 1922 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaccaucacagaugcugatt

SEQ ID NO: 1923 - RNA, 21 nt, Artificial Sequence
  Synthetic
  misc_feature (20)..(21): 2'-O-methyl
ucagcaucugugaugguucuu

SEQ ID NO: 1924 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucacauccuagcucgggatt

SEQ ID NO: 1925 - RNA, 21 nt, Artificial Sequence
  Synthetic
  misc_feature (20)..(21): 2'-O-methyl
ucccgagcuaggaugugaauu

SEQ ID NO: 1926 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcagaucccaucuacacatt

SEQ ID NO: 1927 - RNA, 21 nt, Artificial Sequence
  Synthetic
  misc_feature (20)..(21): 2'-O-methyl
uguguagaugggaucugcauu

SEQ ID NO: 1928 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacuaaauaccauuccautt

SEQ ID NO: 1929 - RNA, 21 nt, Artificial Sequence
  Synthetic
  misc_feature (20)..(21): 2'-O-methyl
auggaaugguauuuaguccuu

SEQ ID NO: 1930 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcuauuguacguaccautt

SEQ ID NO: 1931 - RNA, 21 nt, Artificial Sequence
  Synthetic
  misc_feature (20)..(21): 2'-O-methyl
augguacguacaauagcaguu

SEQ ID NO: 1932 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaggacuaaauaccauutt

SEQ ID NO: 1933 - RNA, 21 nt, Artificial Sequence
  Synthetic
  misc_feature (20)..(21): 2'-O-methyl
aaugguauuuaguccucuguu

SEQ ID NO: 1934 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauaaaggcuacuguuggatt

SEQ ID NO: 1935 - RNA, 21 nt, Artificial Sequence
  Synthetic
  misc_feature (20)..(21): 2'-O-methyl
uccaacaguagccuuuaucuu

SEQ ID NO: 1936 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaugauauaaaugugguctt

SEQ ID NO: 1937 - RNA, 21 nt, Artificial Sequence
  Synthetic
  misc_feature (20)..(21): 2'-O-methyl
gaccacauuuauaucaucuuu

SEQ ID NO: 1938 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaaucaugcaccuuugcgutt

SEQ ID NO: 1939 - RNA, 21 nt, Artificial Sequence
  Synthetic
  misc_feature (20)..(21): 2'-O-methyl
acgcaaaggugcaugauuuuu

SEQ ID NO: 1940 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acgacagacugccuucaaatt

SEQ ID NO: 1941 - RNA, 21 nt, Artificial Sequence
  Synthetic
  misc_feature (20)..(21): 2'-O-methyl
uuugaaggcagucugucguuu

SEQ ID NO: 1942 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaguaaauauaaugaggactt

SEQ ID NO: 1943 - RNA, 21 nt, Artificial Sequence
  Synthetic
  misc_feature (20)..(21): 2'-O-methyl
guccucauuauauuuacuauu

SEQ ID NO: 1944 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaugaggaccuauacuuatt

SEQ ID NO: 1945 - RNA, 21 nt, Artificial Sequence
  Synthetic
  misc_feature (20)..(21): 2'-O-methyl
uaaguauagguccucauuauu

SEQ ID NO: 1946 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcugaaacaugcaguugutt

SEQ ID NO: 1947 - RNA, 21 nt, Artificial Sequence
  Synthetic
  misc_feature (20)..(21): 2'-O-methyl
acaacugcauguuucagcauu

SEQ ID NO: 1948 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuugauggaguuggacautt

SEQ ID NO: 1949 - RNA, 21 nt, Artificial Sequence
  Synthetic
  misc_feature (20)..(21): 2'-O-methyl
auguccaacuccaucaaauuu

SEQ ID NO: 1950 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugccaagugggugguauatt

SEQ ID NO: 1951 - RNA, 21 nt, Artificial Sequence
  Synthetic
  misc_feature (20)..(21): 2'-O-methyl
uauaccacccacuuggcaguu

SEQ ID NO: 1952 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggacuaccaguugugguutt

SEQ ID NO: 1953 - RNA, 21 nt, Artificial Sequence
  Synthetic
  misc_feature (20)..(21): 2'-O-methyl
aaccacaacugguaguccauu

SEQ ID NO: 1954 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuaauaaggcugcaguuautt

SEQ ID NO: 1955 - RNA, 21 nt, Artificial Sequence
  Synthetic
  misc_feature (20)..(21): 2'-O-methyl
auaacugcagccuuauuaauu

SEQ ID NO: 1956 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaucaagaaggagcuaaatt

SEQ ID NO: 1957 - RNA, 21 nt, Artificial Sequence
  Synthetic
  misc_feature (20)..(21): 2'-O-methyl
uuuagcuccuucuugauguuu

SEQ ID NO: 1958 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggauaucgccaggaugauctt

SEQ ID NO: 1959 - RNA, 21 nt, Artificial Sequence
  Synthetic
  misc_feature (20)..(21): 2'-O-methyl
gaucauccuggcgauauccuu

SEQ ID NO: 1960 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuauccaguugaugggcugtt

SEQ ID NO: 1961 - RNA, 21 nt, Artificial Sequence
  Synthetic
  misc_feature (20)..(21): 2'-O-methyl
cagcccaucaacuggauaguu

SEQ ID NO: 1962 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugacagaguuacuucacutt

SEQ ID NO: 1963 - RNA, 21 nt, Artificial Sequence
  Synthetic
  misc_feature (20)..(21): 2'-O-methyl
agugaaguaacucugucaguu

SEQ ID NO: 1964 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugacagggaagacaucactt

SEQ ID NO: 1965 - RNA, 21 nt, Artificial Sequence
  Synthetic
  misc_feature (20)..(21): 2'-O-methyl
gugaugucuucccugucacuu

SEQ ID NO: 1966 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaucccacuaauguccagtt

SEQ ID NO: 1967 - RNA, 21 nt, Artificial Sequence
  Synthetic
  misc_feature (20)..(21): 2'-O-methyl
cuggacauuagugggaugauu

SEQ ID NO: 1968 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugccaucugugcucuucgtt

SEQ ID NO: 1969 - RNA, 21 nt, Artificial Sequence
  Synthetic
  misc_feature (20)..(21): 2'-O-methyl
cgaagagcacagauggcaguu

SEQ ID NO: 1970 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auauaaauguggucaccugtt

SEQ ID NO: 1971 - RNA, 21 nt, Artificial Sequence
  Synthetic
  misc_feature (20)..(21): 2'-O-methyl
caggugaccacauuuauauuu

SEQ ID NO: 1972 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugcugacuauccaguugtt

SEQ ID NO: 1973 - RNA, 21 nt, Artificial Sequence
  Synthetic
  misc_feature (20)..(21): 2'-O-methyl
caacuggauagucagcaccuu

SEQ ID NO: 1974 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccacccuggugcugacuautt

SEQ ID NO: 1975 - RNA, 21 nt, Artificial Sequence
  Synthetic
  misc_feature (20)..(21): 2'-O-methyl
auagucagcaccagggugguu

SEQ ID NO: 1976 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcucuucgucaucugacctt

SEQ ID NO: 1977 - RNA, 21 nt, Artificial Sequence
  Synthetic
  misc_feature (20)..(21): 2'-O-methyl
ggucagaugacgaagagcauu

SEQ ID NO: 1978 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acagggaagacaucacugatt

SEQ ID NO: 1979 - RNA, 21 nt, Artificial Sequence
  Synthetic
  misc_feature (20)..(21): 2'-O-methyl
ucagugaugucuucccuguuu

SEQ ID NO: 1980 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguuggacauggccauggatt

SEQ ID NO: 1981 - RNA, 21 nt, Artificial Sequence
  Synthetic
  misc_feature (20)..(21): 2'-O-methyl
uccauggccauguccaacuuu

SEQ ID NO: 1982 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuggcugaaccaucacagatt

SEQ ID NO: 1983 - RNA, 21 nt, Artificial Sequence
  Synthetic
  misc_feature (20)..(21): 2'-O-methyl
ucugugaugguucagccaauu

SEQ ID NO: 1984 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagaugagggcaugcagautt

SEQ ID NO: 1985 - RNA, 21 nt, Artificial Sequence
  Synthetic
  misc_feature (20)..(21): 2'-O-methyl
aucugcaugcccucaucuauu

SEQ ID NO: 1986 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaugagggcaugcagauctt

SEQ ID NO: 1987 - RNA, 21 nt, Artificial Sequence
  Synthetic
  misc_feature (20)..(21): 2'-O-methyl
gaucugcaugcccucaucuuu

SEQ ID NO: 1988 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucugugcucuucgucauctt

SEQ ID NO: 1989 - RNA, 21 nt, Artificial Sequence
  Synthetic
  misc_feature (20)..(21): 2'-O-methyl
gaugacgaagagcacagauuu

SEQ ID NO: 1990 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaacuugccacacgugcaatt

SEQ ID NO: 1991 - RNA, 21 nt, Artificial Sequence
  Synthetic
  misc_feature (20)..(21): 2'-O-methyl
uugcacguguggcaaguucuu

SEQ ID NO: 1992 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaucugugcucuucgucatt

SEQ ID NO: 1993 - RNA, 21 nt, Artificial Sequence
  Synthetic
  misc_feature (20)..(21): 2'-O-methyl
ugacgaagagcacagaugguu

SEQ ID NO: 1994 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucacuugcaauaauuauatt

SEQ ID NO: 1995 - RNA, 21 nt, Artificial Sequence
  Synthetic
  misc_feature (20)..(21): 2'-O-methyl
uauaauuauugcaagugaguu

SEQ ID NO: 1996 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaccaugcagaauacaaatt

SEQ ID NO: 1997 - RNA, 21 nt, Artificial Sequence
  Synthetic
  misc_feature (20)..(21): 2'-O-methyl
uuuguauucugcaugguacuu

SEQ ID NO: 1998 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggcaaccaagaaagcaatt

SEQ ID NO: 1999 - RNA, 21 nt, Artificial Sequence
  Synthetic
  misc_feature (20)..(21): 2'-O-methyl
uugcuuucuugguugccauuu

SEQ ID NO: 2000 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaacaugcaguuguaaactt

SEQ ID NO: 2001 - RNA, 21 nt, Artificial Sequence
  Synthetic
  misc_feature (20)..(21): 2'-O-methyl
guuuacaacugcauguuucuu

SEQ ID NO: 2002 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagacacgcuaucaugcgutt

SEQ ID NO: 2003 - RNA, 21 nt, Artificial Sequence
  Synthetic
  misc_feature (20)..(21): 2'-O-methyl
acgcaugauagcgugucuguu

SEQ ID NO: 2004 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccacaagauuacaagaaatt

SEQ ID NO: 2005 - RNA, 21 nt, Artificial Sequence
  Synthetic
  misc_feature (20)..(21): 2'-O-methyl
uuucuuguaaucuuguggcuu

SEQ ID NO: 2006 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguuaagcucuuacaccctt

SEQ ID NO: 2007 - RNA, 21 nt, Artificial Sequence
  Synthetic
  misc_feature (20)..(21): 2'-O-methyl
ggguguaagagcuuaaccauu

SEQ ID NO: 2008 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcuuuaguaaauauaaugtt

SEQ ID NO: 2009 - RNA, 21 nt, Artificial Sequence
  Synthetic
  misc_feature (20)..(21): 2'-O-methyl
cauuauauuuacuaaagcuuu

SEQ ID NO: 2010 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaucaagaugaugcagaatt

SEQ ID NO: 2011 - RNA, 21 nt, Artificial Sequence
  Synthetic
  misc_feature (20)..(21): 2'-O-methyl
uucugcaucaucuugauaguu

SEQ ID NO: 2012 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagucaacgucuuguucagtt

SEQ ID NO: 2013 - RNA, 21 nt, Artificial Sequence
  Synthetic
  misc_feature (20)..(21): 2'-O-methyl
cugaacaagacguugacuuuu

SEQ ID NO: 2014 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2015 - RNA, 21 nt, Artificial Sequence
  Synthetic
  misc_feature (20)..(21): 2'-O-methyl
  misc_feature (20)..(21): phosphorothioate linkage
uuucgaaucaauccaacaguu

SEQ ID NO: 2016 - RNA, 21 nt, Artificial Sequence
  Synthetic
  misc_feature (1)..(4): 2'-deoxy-2'-fluoro
  misc_feature (8)..(9): 2'-deoxy-2'-fluoro
  misc_feature (12)..(14): 2'-deoxy-2'-fluoro
  misc_feature (17)..(17): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2017 - RNA, 21 nt, Artificial Sequence
  Synthetic
  misc_feature (1)..(1): inverted abasic cap
  misc_feature (1)..(2): 2'-deoxy-2'-fluoro
  misc_feature (4)..(5): 2'-deoxy-2'-fluoro
  misc_feature (9)..(10): 2'-deoxy-2'-fluoro
  misc_feature (13)..(15): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2018 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(3): 2'-deoxy
  misc_feature (4)..(5): 2'-deoxy-2'-fluoro
  misc_feature (6)..(8): 2'-deoxy
  misc_feature (9)..(10): 2'-deoxy-2'-fluoro
  misc_feature (11)..(12): 2'-deoxy
  misc_feature (13)..(15): 2'-deoxy-2'-fluoro
  misc_feature (16)..(19): 2'-deoxy
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2019 - RNA, 21 nt, Artificial Sequence
  Synthetic
  misc_feature (4)..(4): 2'-deoxy-2'-fluoro
  misc_feature (5)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
  misc_feature (20)..(21): phosphorothioate linkage
uuucgaaucaauccaacaguu

SEQ ID NO: 2020 - RNA, 21 nt, Artificial Sequence
  Synthetic
  misc_feature (1)..(1): inverted abasic cap
  misc_feature (1)..(2): 2'-O-methyl
  misc_feature (4)..(5): 2'-O-methyl
  misc_feature (9)..(10): 2'-O-methyl
  misc_feature (13)..(15): 2'-O-methyl
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2021 - RNA, 21 nt, Artificial Sequence
  Synthetic
  misc_feature (1)..(1): inverted abasic cap
  misc_feature (3)..(3): 2'-O-methyl
  misc_feature (6)..(8): 2'-O-methyl
  misc_feature (11)..(12): 2'-O-methyl
  misc_feature (16)..(21): 2'-O-methyl
  misc_feature (20)..(21): phosphorothioate linkage
  misc_feature (21)..(21): inverted abasic cap
cuguuggauugauucgaaauu

SEQ ID NO: 2022 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(3): 2'-O-methyl
  misc_feature (4)..(5): 2'-deoxy-2'-fluoro
  misc_feature (6)..(8): 2'-O-methyl
  misc_feature (9)..(10): 2'-deoxy-2'-fluoro
  misc_feature (11)..(12): 2'-O-methyl
  misc_feature (13)..(15): 2'-deoxy-2'-fluoro
  misc_feature (16)..(21): 2'-O-methyl
  misc_feature (20)..(21): phosphorothioate linkage
  misc_feature (21)..(21): inverted abasic cap
cuguuggauugauucgaaauu

SEQ ID NO: 2023 - RNA, 21 nt, Artificial Sequence
  Synthetic
  misc_feature (5)..(7): 2'-deoxy-2'-fluoro
  misc_feature (10)..(11): 2'-deoxy-2'-fluoro
  misc_feature (15)..(16): 2'-deoxy-2'-fluoro
  misc_feature (18)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2024 - RNA, 21 nt, Artificial Sequence
  Synthetic
  misc_feature (5)..(7): 2'-O-methyl
  misc_feature (10)..(11): 2'-O-methyl
  misc_feature (15)..(16): 2'-O-methyl
  misc_feature (18)..(21): 2'-O-methyl
  misc_feature (20)..(21): phosphorothioate linkage
uuucgaaucaauccaacaguu

SEQ ID NO: 2025 - RNA, 21 nt, Artificial Sequence
  Synthetic
  misc_feature (4)..(4): 2'-O-methyl
  misc_feature (8)..(9): 2'-O-methyl
  misc_feature (12)..(13): 2'-O-methyl
  misc_feature (17)..(17): 2'-O-methyl
  misc_feature (20)..(21): 2'-O-methyl
  misc_feature (20)..(21): phosphorothioate linkage
uuucgaaucaauccaacaguu

SEQ ID NO: 2026 - RNA, 21 nt, Artificial Sequence
  Synthetic
  misc_feature (4)..(4): 2'-O-methyl
  misc_feature (5)..(7): 2'-deoxy-2'-fluoro
  misc_feature (8)..(9): 2'-O-methyl
  misc_feature (10)..(11): 2'-deoxy-2'-fluoro
  misc_feature (12)..(13): 2'-O-methyl
  misc_feature (15)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2027 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2028 - RNA, 21 nt, Artificial Sequence
  Synthetic
  misc_feature (20)..(21): 2'-O-methyl
  misc_feature (20)..(21): phosphorothioate linkage
auagcuaggaucauccugguu

SEQ ID NO: 2029 - RNA, 21 nt, Artificial Sequence
  Synthetic
  misc_feature (1)..(1): inverted abasic cap
  misc_feature (1)..(2): 2'-deoxy-2'-fluoro
  misc_feature (7)..(7): 2'-deoxy-2'-fluoro
  misc_feature (10)..(13): 2'-deoxy-2'-fluoro
  misc_feature (16)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2030 - RNA, 21 nt, Artificial Sequence
  Synthetic
  misc_feature (2)..(2): 2'-deoxy-2'-fluoro
  misc_feature (5)..(6): 2'-deoxy-2'-fluoro
  misc_feature (11)..(12): 2'-deoxy-2'-fluoro
  misc_feature (14)..(17): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2031 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(6): 2'-deoxy
  misc_feature (7)..(7): 2'-deoxy-2'-fluoro
  misc_feature (8)..(9): 2'-deoxy
  misc_feature (10)..(13): 2'-deoxy-2'-fluoro
  misc_feature (14)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2032 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
  misc_feature (20)..(21): phosphorothioate linkage
auagcuaggaucauccugguu

SEQ ID NO: 2033 - RNA, 21 nt, Artificial Sequence
  Synthetic
  misc_feature (1)..(1): inverted abasic cap
  misc_feature (1)..(2): 2'-O-methyl
  misc_feature (7)..(7): 2'-O-methyl
  misc_feature (10)..(13): 2'-O-methyl
  misc_feature (16)..(17): 2'-O-methyl
  misc_feature (19)..(21): 2'-O-methyl
  misc_feature (20)..(21): phosphorothioate linkage
  misc_feature (21)..(21): inverted abasic cap
ccaggaugauccuagcuauuu

SEQ ID NO: 2034 - RNA, 21 nt, Artificial Sequence
  Synthetic
  misc_feature (1)..(1): inverted abasic cap
  misc_feature (3)..(6): 2'-O-methyl
  misc_feature (8)..(9): 2'-O-methyl
  misc_feature (14)..(15): 2'-O-methyl
  misc_feature (18)..(18): 2'-O-methyl
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2035 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(6): 2'-O-methyl
  misc_feature (7)..(7): 2'-deoxy-2'-fluoro
  misc_feature (8)..(9): 2'-O-methyl
  misc_feature (10)..(13): 2'-deoxy-2'-fluoro
  misc_feature (14)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2036 - RNA, 21 nt, Artificial Sequence
  Synthetic
  misc_feature (4)..(4): 2'-deoxy-2'-fluoro
  misc_feature (7)..(10): 2'-deoxy-2'-fluoro
  misc_feature (13)..(13): 2'-deoxy-2'-fluoro
  misc_feature (18)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2037 - RNA, 21 nt, Artificial Sequence
  Synthetic
  misc_feature (4)..(4): 2'-O-methyl
  misc_feature (7)..(10): 2'-O-methyl
  misc_feature (13)..(13): 2'-O-methyl
  misc_feature (18)..(21): 2'-O-methyl
  misc_feature (20)..(21): phosphorothioate linkage
auagcuaggaucauccugguu

SEQ ID NO: 2038 - RNA, 21 nt, Artificial Sequence
  Synthetic
  misc_feature (5)..(6): 2'-O-methyl
  misc_feature (11)..(12): 2'-O-methyl
  misc_feature (15)..(17): 2'-O-methyl
  misc_feature (20)..(21): 2'-O-methyl
  misc_feature (20)..(21): phosphorothioate linkage
auagcuaggaucauccugguu

SEQ ID NO: 2039 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(10): 2'-deoxy-2'-fluoro
  misc_feature (11)..(12): 2'-O-methyl
  misc_feature (13)..(13): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2040 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2041 - RNA, 21 nt, Artificial Sequence
  Synthetic
  misc_feature (20)..(21): 2'-O-methyl
  misc_feature (20)..(21): phosphorothioate linkage
aagcaacugaacuagucguuu

SEQ ID NO: 2042 - RNA, 21 nt, Artificial Sequence
  Synthetic
  misc_feature (1)..(1): inverted abasic cap
  misc_feature (2)..(2): 2'-deoxy-2'-fluoro
  misc_feature (5)..(6): 2'-deoxy-2'-fluoro
  misc_feature (9)..(11): 2'-deoxy-2'-fluoro
  misc_feature (14)..(15): 2'-deoxy-2'-fluoro
  misc_feature (17)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2043 - RNA, 21 nt, Artificial Sequence
  Synthetic
  misc_feature (4)..(4): 2'-deoxy-2'-fluoro
  misc_feature (7)..(8): 2'-deoxy-2'-fluoro
  misc_feature (12)..(13): 2'-deoxy-2'-fluoro
  misc_feature (16)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2044 - RNA, 21 nt, Artificial Sequence
  Synthetic
  misc_feature (1)..(1): inverted abasic cap
  misc_feature (1)..(1): 2'-deoxy
  misc_feature (2)..(2): 2'-deoxy-2'-fluoro
  misc_feature (3)..(4): 2'-deoxy
  misc_feature (5)..(6): 2'-deoxy-2'-fluoro
  misc_feature (7)..(8): 2'-deoxy
  misc_feature (9)..(11): 2'-deoxy-2'-fluoro
  misc_feature (12)..(13): 2'-deoxy
  misc_feature (14)..(15): 2'-deoxy-2'-fluoro
  misc_feature (16)..(16): 2'-deoxy
  misc_feature (17)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2045 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2046 - RNA, 21 nt, Artificial Sequence
  Synthetic
  misc_feature (1)..(1): inverted abasic cap
  misc_feature (2)..(2): 2'-O-methyl
  misc_feature (5)..(6): 2'-O-methyl
  misc_feature (9)..(11): 2'-O-methyl
  misc_feature (14)..(15): 2'-O-methyl
  misc_feature (17)..(21): 2'-O-methyl
  misc_feature (20)..(21): phosphorothioate linkage
  misc_feature (21)..(21): inverted abasic cap
acgacuaguucaguugcuuuu

SEQ ID NO: 2047 - RNA, 21 nt, Artificial Sequence
  Synthetic
  misc_feature (1)..(1): inverted abasic cap
  misc_feature (1)..(1): 2'-O-methyl
  misc_feature (3)..(4): 2'-O-methyl
  misc_feature (7)..(8): 2'-O-methyl
  misc_feature (12)..(13): 2'-O-methyl
  misc_feature (16)..(16): 2'-O-methyl
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2048 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy-2'-fluoro
  misc_feature (3)..(4): 2'-O-methyl
  misc_feature (5)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2049 - RNA, 21 nt, Artificial Sequence
  Synthetic
  misc_feature (5)..(6): 2'-deoxy-2'-fluoro
  misc_feature (9)..(11): 2'-deoxy-2'-fluoro
  misc_feature (14)..(15): 2'-deoxy-2'-fluoro
  misc_feature (18)..(18): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2050 - RNA, 21 nt, Artificial Sequence
  Synthetic
  misc_feature (5)..(6): 2'-O-methyl
  misc_feature (9)..(11): 2'-O-methyl
  misc_feature (15)..(15): 2'-O-methyl
  misc_feature (18)..(18): 2'-O-methyl
  misc_feature (20)..(21): 2'-O-methyl
  misc_feature (20)..(21): phosphorothioate linkage
aagcaacugaacuagucguuu

SEQ ID NO: 2051 - RNA, 21 nt, Artificial Sequence
  Synthetic
  misc_feature (4)..(4): 2'-O-methyl
  misc_feature (7)..(8): 2'-O-methyl
  misc_feature (12)..(13): 2'-O-methyl
  misc_feature (16)..(17): 2'-O-methyl
  misc_feature (19)..(21): 2'-O-methyl
  misc_feature (20)..(21): phosphorothioate linkage
aagcaacugaacuagucguuu

SEQ ID NO: 2052 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(15): 2'-deoxy-2'-fluoro
  misc_feature (16)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
aagcaacugaacuagucguuu

SEQ ID NO: 2053 - RNA, 21 nt, Artificial Sequence
  Synthetic
  misc_feature (1)..(1): inverted abasic cap
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2054 - RNA, 21 nt, Artificial Sequence
  Synthetic
  misc_feature (20)..(21): 2'-O-methyl
  misc_feature (20)..(21): phosphorothioate linkage
acgauagcuaggaucauccuu

SEQ ID NO: 2055 - RNA, 21 nt, Artificial Sequence
  Synthetic
  misc_feature (1)..(1): inverted abasic cap
  misc_feature (4)..(4): 2'-deoxy-2'-fluoro
  misc_feature (7)..(10): 2'-deoxy-2'-fluoro
  misc_feature (13)..(14): 2'-deoxy-2'-fluoro
  misc_feature (16)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2056 - RNA, 21 nt, Artificial Sequence
  Synthetic
  misc_feature (2)..(2): 2'-deoxy-2'-fluoro
  misc_feature (5)..(5): 2'-deoxy-2'-fluoro
  misc_feature (8)..(9): 2'-deoxy-2'-fluoro
  misc_feature (14)..(15): 2'-deoxy-2'-fluoro
  misc_feature (17)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2057 - RNA, 21 nt, Artificial Sequence
  Synthetic
  misc_feature (1)..(1): inverted abasic cap
  misc_feature (1)..(3): 2'-deoxy
  misc_feature (4)..(4): 2'-deoxy-2'-fluoro
  misc_feature (5)..(6): 2'-deoxy
  misc_feature (7)..(10): 2'-deoxy-2'-fluoro
  misc_feature (11)..(12): 2'-deoxy
  misc_feature (13)..(14): 2'-deoxy-2'-fluoro
  misc_feature (15)..(15): 2'-deoxy
  misc_feature (16)..(17): 2'-deoxy-2'-fluoro
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2058 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2059 - RNA, 21 nt, Artificial Sequence
  Synthetic
  misc_feature (1)..(1): inverted abasic cap
  misc_feature (4)..(4): 2'-O-methyl
  misc_feature (7)..(10): 2'-O-methyl
  misc_feature (13)..(14): 2'-O-methyl
  misc_feature (16)..(17): 2'-O-methyl
  misc_feature (19)..(21): 2'-O-methyl
  misc_feature (20)..(21): phosphorothioate linkage
  misc_feature (21)..(21): inverted abasic cap
ggaugauccuagcuaucguuu

SEQ ID NO: 2060 - RNA, 21 nt, Artificial Sequence
  Synthetic
  misc_feature (1)..(1): inverted abasic cap
  misc_feature (1)..(3): 2'-O-methyl
  misc_feature (5)..(6): 2'-O-methyl
  misc_feature (11)..(12): 2'-O-methyl
  misc_feature (15)..(15): 2'-O-methyl
  misc_feature (18)..(18): 2'-O-methyl
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2061 - RNA, 21 nt, Artificial Sequence
  Synthetic
  misc_feature (1)..(1): inverted abasic cap
  misc_feature (1)..(3): 2'-O-methyl
  misc_feature (4)..(4): 2'-deoxy-2'-fluoro
  misc_feature (5)..(6): 2'-O-methyl
  misc_feature (7)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2062 - RNA, 21 nt, Artificial Sequence
  Synthetic
  misc_feature (4)..(4): 2'-deoxy-2'-fluoro
  misc_feature (6)..(7): 2'-deoxy-2'-fluoro
  misc_feature (10)..(13): 2'-deoxy-2'-fluoro
  misc_feature (16)..(16): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2063 - RNA, 21 nt, Artificial Sequence
  Synthetic
  misc_feature (4)..(4): 2'-O-methyl
  misc_feature (6)..(7): 2'-O-methyl
  misc_feature (10)..(13): 2'-O-methyl
  misc_feature (16)..(16): 2'-O-methyl
  misc_feature (20)..(21): 2'-O-methyl
  misc_feature (20)..(21): phosphorothioate linkage
acgauagcuaggaucauccuu

SEQ ID NO: 2064 - RNA, 21 nt, Artificial Sequence
  Synthetic
  misc_feature (5)..(5): 2'-O-methyl
  misc_feature (8)..(9): 2'-O-methyl
  misc_feature (15)..(15): 2'-O-methyl
  misc_feature (17)..(21): 2'-O-methyl
  misc_feature (20)..(21): phosphorothioate linkage
acgauagcuaggaucauccuu

SEQ ID NO: 2065 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(7): 2'-deoxy-2'-fluoro
  misc_feature (8)..(9): 2'-O-methyl
  misc_feature (10)..(13): 2'-deoxy-2'-fluoro
  misc_feature (15)..(15): 2'-O-methyl
  misc_feature (16)..(16): 2'-deoxy-2'-fluoro
  misc_feature (17)..(21): 2'-O-methyl
  misc_feature (20)..(21): phosphorothioate linkage
acgauagcuaggaucauccuu

SEQ ID NO: 2066 - RNA, 21 nt, Artificial Sequence
  Synthetic
  misc_feature (1)..(1): inverted abasic cap
  misc_feature (2)..(2): 2'-O-methyl
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy
  misc_feature (10)..(10): 2'-O-methyl
  misc_feature (11)..(11): 2'-deoxy
  misc_feature (13)..(16): 2'-deoxy
  misc_feature (17)..(17): 2'-deoxy-2'-fluoro
  misc_feature (18)..(18): 2'-deoxy
  misc_feature (19)..(21): 2'-O-methyl
  misc_feature (20)..(21): phosphorothioate linkage
  misc_feature (21)..(21): inverted abasic cap
cuguuggauugauucgaaauu

SEQ ID NO: 2067 - RNA, 21 nt, Artificial Sequence
  Synthetic
  misc_feature (1)..(3): 2'-O-methyl
  misc_feature (6)..(6): 2'-deoxy-2'-fluoro
  misc_feature (7)..(8): 2'-O-methyl
  misc_feature (10)..(10): 2'-O-methyl
  misc_feature (11)..(15): 2'-deoxy-2'-fluoro
  misc_feature (16)..(16): 2'-O-methyl
  misc_feature (20)..(21): 2'-O-methyl
  misc_feature (20)..(21): phosphorothioate linkage
uuucgaaucaauccaacaguu

SEQ ID NO: 2068 - RNA, 21 nt, Artificial Sequence
  Synthetic
  misc_feature (1)..(4): 2'-deoxy-2'-fluoro
  misc_feature (5)..(6): 2'-O-methyl
  misc_feature (7)..(8): 2'-deoxy-2'-fluoro
  misc_feature (10)..(10): 2'-deoxy-2'-fluoro
  misc_feature (11)..(11): 2'-O-methyl
  misc_feature (13)..(13): 2'-O-methyl
  misc_feature (14)..(14): 2'-deoxy-2'-fluoro
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2069 - RNA, 21 nt, Artificial Sequence
  Synthetic
  misc_feature (1)..(1): inverted abasic cap
  misc_feature (2)..(2): 2'-deoxy
  misc_feature (4)..(4): 2'-O-methyl
  misc_feature (5)..(5): 2'-deoxy-2'-fluoro
  misc_feature (6)..(6): 2'-deoxy
  misc_feature (7)..(7): 2'-O-methyl
  misc_feature (8)..(8): 2'-deoxy-2'-fluoro
  misc_feature (9)..(11): 2'-deoxy
  misc_feature (12)..(12): 2'-deoxy-2'-fluoro
  misc_feature (13)..(13): 2'-O-methyl
  misc_feature (15)..(16): 2'-deoxy
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2070 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(5): 2'-deoxy-2'-fluoro
  misc_feature (7)..(7): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-O-methyl
  misc_feature (18)..(21): 2'-O-methyl
  misc_feature (20)..(21): phosphorothioate linkage
uuucgaaucaauccaacaguu

SEQ ID NO: 2071 - RNA, 21 nt, Artificial Sequence
  Synthetic
  misc_feature (1)..(1): inverted abasic cap
  misc_feature (1)..(4): 2'-deoxy
  misc_feature (5)..(5): 2'-deoxy-2'-fluoro
  misc_feature (6)..(6): 2'-deoxy
  misc_feature (7)..(8): 2'-deoxy-2'-fluoro
  misc_feature (10)..(11): 2'-O-methyl
  misc_feature (12)..(12): 2'-deoxy
  misc_feature (14)..(14): 2'-deoxy-2'-fluoro
  misc_feature (15)..(15): 2'-O-methyl
  misc_feature (17)..(17): 2'-deoxy-2'-fluoro
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2072 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy-2'-fluoro
  misc_feature (5)..(6): 2'-deoxy
  misc_feature (7)..(8): 2'-deoxy-2'-fluoro
  misc_feature (9)..(11): 2'-deoxy
  misc_feature (12)..(12): 2'-deoxy-2'-fluoro
  misc_feature (13)..(15): 2'-deoxy
  misc_feature (16)..(16): 2'-deoxy-2'-fluoro
  misc_feature (17)..(17): 2'-deoxy
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2073 - RNA, 21 nt, Artificial Sequence
  Synthetic
  misc_feature (1)..(4): 2'-O-methyl
  misc_feature (6)..(7): 2'-deoxy-2'-fluoro
  misc_feature (8)..(12): 2'-O-methyl
  misc_feature (14)..(14): 2'-deoxy-2'-fluoro
  misc_feature (15)..(15): 2'-O-methyl
  misc_feature (16)..(18): 2'-deoxy-2'-fluoro
  misc_feature (19)..(21): 2'-O-methyl
  misc_feature (20)..(21): phosphorothioate linkage
uuucgaaucaauccaacaguu

SEQ ID NO: 2074 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy-2'-fluoro
  misc_feature (4)..(4): 2'-deoxy
  misc_feature (5)..(5): 2'-O-methyl
  misc_feature (7)..(7): 2'-O-methyl
  misc_feature (8)..(8): 2'-deoxy
  misc_feature (9)..(9): 2'-O-methyl
  misc_feature (11)..(11): 2'-deoxy
  misc_feature (12)..(13): 2'-O-methyl
  misc_feature (14)..(14): 2'-deoxy-2'-fluoro
  misc_feature (15)..(15): 2'-deoxy
  misc_feature (16)..(16): 2'-deoxy-2'-fluoro
  misc_feature (17)..(17): 2'-deoxy
  misc_feature (18)..(18): 2'-O-methyl
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2075 - RNA, 21 nt, Artificial Sequence
  Synthetic
  misc_feature (1)..(2): 2'-O-methyl
  misc_feature (3)..(4): 2'-deoxy-2'-fluoro
  misc_feature (6)..(6): 2'-deoxy-2'-fluoro
  misc_feature (11)..(12): 2'-O-methyl
  misc_feature (14)..(14): 2'-deoxy-2'-fluoro
  misc_feature (15)..(15): 2'-O-methyl
  misc_feature (17)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2076 - RNA, 21 nt, Artificial Sequence
  Synthetic
  misc_feature (1)..(2): 2'-deoxy-2'-fluoro
  misc_feature (3)..(3): 2'-O-methyl
  misc_feature (6)..(8): 2'-O-methyl
  misc_feature (9)..(11): 2'-deoxy-2'-fluoro
  misc_feature (12)..(12): 2'-O-methyl
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2077 - RNA, 21 nt, Artificial Sequence
  Synthetic
  misc_feature (1)..(1): inverted abasic cap
  misc_feature (2)..(2): 2'-deoxy-2'-fluoro
  misc_feature (3)..(3): 2'-deoxy
  misc_feature (4)..(4): 2'-O-methyl
  misc_feature (5)..(5): 2'-deoxy
  misc_feature (7)..(8): 2'-deoxy-2'-fluoro
  misc_feature (9)..(9): 2'-O-methyl
  misc_feature (11)..(11): 2'-deoxy-2'-fluoro
  misc_feature (12)..(12): 2'-deoxy
  misc_feature (13)..(13): 2'-deoxy-2'-fluoro
  misc_feature (14)..(14): 2'-O-methyl
  misc_feature (16)..(16): 2'-O-methyl
  misc_feature (17)..(17): 2'-deoxy
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2078 - RNA, 21 nt, Artificial Sequence
  Synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (5)..(6): 2'-O-methyl
  misc_feature (9)..(9): 2'-O-methyl
  misc_feature (10)..(11): 2'-deoxy-2'-fluoro
  misc_feature (13)..(13): 2'-deoxy-2'-fluoro
  misc_feature (15)..(15): 2'-O-methyl
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
uuucgaaucaauccaacaguu

SEQ ID NO: 2079 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy-2'-fluoro
  misc_feature (5)..(5): 2'-O-methyl
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(10): 2'-deoxy
  misc_feature (11)..(11): 2'-O-methyl
  misc_feature (12)..(13): 2'-deoxy
  misc_feature (14)..(14): 2'-O-methyl
  misc_feature (16)..(16): 2'-deoxy
  misc_feature (17)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2080 - RNA, 21 nt, Artificial Sequence
  Synthetic
  misc_feature (1)..(1): inverted abasic cap
  misc_feature (2)..(7): 2'-deoxy
  misc_feature (8)..(9): 2'-O-methyl
  misc_feature (10)..(10): 2'-deoxy
  misc_feature (11)..(11): 2'-O-methyl
  misc_feature (12)..(12): 2'-deoxy-2'-fluoro
  misc_feature (13)..(14): 2'-deoxy
  misc_feature (15)..(15): 2'-O-methyl
  misc_feature (16)..(17): 2'-deoxy
  misc_feature (18)..(18): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2081 - RNA, 21 nt, Artificial Sequence
  Synthetic
  misc_feature (1)..(2): 2'-O-methyl
  misc_feature (3)..(4): 2'-deoxy-2'-fluoro
  misc_feature (5)..(5): 2'-O-methyl
  misc_feature (7)..(7): 2'-O-methyl
  misc_feature (8)..(8): 2'-deoxy-2'-fluoro
  misc_feature (10)..(11): 2'-deoxy-2'-fluoro
  misc_feature (12)..(12): 2'-O-methyl
  misc_feature (15)..(15): 2'-O-methyl
  misc_feature (16)..(17): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2082 - RNA, 21 nt, Artificial Sequence
  Synthetic
  misc_feature (1)..(3): 2'-deoxy-2'-fluoro
  misc_feature (4)..(4): 2'-O-methyl
  misc_feature (5)..(6): 2'-deoxy-2'-fluoro
  misc_feature (7)..(8): 2'-O-methyl
  misc_feature (11)..(13): 2'-O-methyl
  misc_feature (14)..(14): 2'-deoxy-2'-fluoro
  misc_feature (15)..(16): 2'-O-methyl
  misc_feature (18)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2083 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy-2'-fluoro
  misc_feature (4)..(4): 2'-O-methyl
  misc_feature (5)..(5): 2'-deoxy
  misc_feature (6)..(6): 2'-O-methyl
  misc_feature (7)..(7): 2'-deoxy-2'-fluoro
  misc_feature (8)..(8): 2'-deoxy
  misc_feature (9)..(9): 2'-O-methyl
  misc_feature (10)..(11): 2'-deoxy-2'-fluoro
  misc_feature (12)..(12): 2'-deoxy
  misc_feature (15)..(15): 2'-O-methyl
  misc_feature (16)..(16): 2'-deoxy-2'-fluoro
  misc_feature (17)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2084 - RNA, 21 nt, Artificial Sequence
  Synthetic
  misc_feature (1)..(1): inverted abasic cap
  misc_feature (1)..(1): 2'-O-methyl
  misc_feature (2)..(3): 2'-deoxy-2'-fluoro
  misc_feature (4)..(4): 2'-deoxy
  misc_feature (6)..(7): 2'-deoxy
  misc_feature (8)..(8): 2'-O-methyl
  misc_feature (9)..(10): 2'-deoxy
  misc_feature (12)..(12): 2'-deoxy-2'-fluoro
  misc_feature (13)..(13): 2'-O-methyl
  misc_feature (15)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2085 - RNA, 21 nt, Artificial Sequence
  Synthetic
  misc_feature (1)..(1): 2'-O-methyl
  misc_feature (2)..(3): 2'-deoxy-2'-fluoro
  misc_feature (5)..(5): 2'-deoxy-2'-fluoro
  misc_feature (6)..(6): 2'-O-methyl
  misc_feature (8)..(11): 2'-O-methyl
  misc_feature (14)..(15): 2'-deoxy-2'-fluoro
  misc_feature (16)..(17): 2'-O-methyl
  misc_feature (20)..(21): 2'-O-methyl
  misc_feature (20)..(21): phosphorothioate linkage
uuucgaaucaauccaacaguu

SEQ ID NO: 2086 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy
  misc_feature (5)..(5): 2'-O-methyl
  misc_feature (6)..(6): 2'-deoxy-2'-fluoro
  misc_feature (7)..(7): 2'-deoxy
  misc_feature (8)..(8): 2'-deoxy-2'-fluoro
  misc_feature (9)..(9): 2'-deoxy
  misc_feature (10)..(11): 2'-deoxy-2'-fluoro
  misc_feature (12)..(12): 2'-deoxy
  misc_feature (14)..(14): 2'-deoxy-2'-fluoro
  misc_feature (15)..(16): 2'-deoxy
  misc_feature (17)..(17): 2'-deoxy-2'-fluoro
  misc_feature (18)..(18): 2'-O-methyl
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2087 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(5): 2'-O-methyl
  misc_feature (6)..(8): 2'-deoxy-2'-fluoro
  misc_feature (9)..(9): 2'-O-methyl
  misc_feature (11)..(11): 2'-deoxy-2'-fluoro
  misc_feature (13)..(15): 2'-deoxy-2'-fluoro
  misc_feature (18)..(21): 2'-O-methyl
  misc_feature (20)..(21): phosphorothioate linkage
uuucgaaucaauccaacaguu

SEQ ID NO: 2088 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy
  misc_feature (4)..(4): 2'-O-methyl
  misc_feature (5)..(5): 2'-deoxy
  misc_feature (6)..(6): 2'-deoxy-2'-fluoro
  misc_feature (8)..(8): 2'-deoxy
  misc_feature (9)..(9): 2'-O-methyl
  misc_feature (10)..(11): 2'-deoxy
  misc_feature (12)..(12): 2'-O-methyl
  misc_feature (13)..(15): 2'-deoxy
  misc_feature (16)..(16): 2'-deoxy-2'-fluoro
  misc_feature (17)..(17): 2'-O-methyl
  misc_feature (18)..(18): 2'-deoxy
  misc_feature (19)..(21): 2'-O-methyl
  misc_feature (20)..(21): phosphorothioate linkage
  misc_feature (21)..(21): inverted abasic cap
cuguuggauugauucgaaauu

SEQ ID NO: 2089 - RNA, 21 nt, Artificial Sequence
  Synthetic
  misc_feature (1)..(3): 2'-O-methyl
  misc_feature (5)..(5): 2'-deoxy-2'-fluoro
  misc_feature (6)..(6): 2'-O-methyl
  misc_feature (7)..(8): 2'-deoxy-2'-fluoro
  misc_feature (9)..(10): 2'-O-methyl
  misc_feature (13)..(13): 2'-O-methyl
  misc_feature (14)..(14): 2'-deoxy-2'-fluoro
  misc_feature (17)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2090 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (5)..(6): 2'-O-methyl
  misc_feature (8)..(10): 2'-O-methyl
  misc_feature (11)..(11): 2'-deoxy-2'-fluoro
  misc_feature (12)..(13): 2'-O-methyl
  misc_feature (14)..(16): 2'-deoxy-2'-fluoro
  misc_feature (18)..(21): 2'-O-methyl
  misc_feature (20)..(21): phosphorothioate linkage
uuucgaaucaauccaacaguu

SEQ ID NO: 2091 - RNA, 21 nt, Artificial Sequence
  Synthetic
  misc_feature (1)..(1): inverted abasic cap
  misc_feature (2)..(2): 2'-deoxy
  misc_feature (3)..(3): 2'-deoxy-2'-fluoro
  misc_feature (4)..(4): 2'-O-methyl
  misc_feature (5)..(5): 2'-deoxy
  misc_feature (6)..(7): 2'-deoxy-2'-fluoro
  misc_feature (8)..(8): 2'-deoxy
  misc_feature (10)..(10): 2'-O-methyl
  misc_feature (11)..(12): 2'-deoxy-2'-fluoro
  misc_feature (13)..(13): 2'-O-methyl
  misc_feature (15)..(16): 2'-deoxy
  misc_feature (17)..(17): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2092 - RNA, 21 nt, Artificial Sequence
  Synthetic
  misc_feature (1)..(1): inverted abasic cap
  misc_feature (1)..(2): 2'-deoxy
  misc_feature (3)..(4): 2'-O-methyl
  misc_feature (6)..(6): 2'-O-methyl
  misc_feature (7)..(7): 2'-deoxy
  misc_feature (8)..(8): 2'-deoxy-2'-fluoro
  misc_feature (9)..(9): 2'-deoxy
  misc_feature (11)..(11): 2'-deoxy
  misc_feature (12)..(12): 2'-deoxy-2'-fluoro
  misc_feature (13)..(13): 2'-deoxy
  misc_feature (14)..(15): 2'-O-methyl
  misc_feature (16)..(16): 2'-deoxy-2'-fluoro
  misc_feature (17)..(19): 2'-deoxy
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2093 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(3): 2'-O-methyl
  misc_feature (7)..(7): 2'-O-methyl
  misc_feature (9)..(12): 2'-deoxy-2'-fluoro
  misc_feature (13)..(13): 2'-O-methyl
  misc_feature (15)..(15): 2'-deoxy-2'-fluoro
  misc_feature (16)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2094 - RNA, 21 nt, Artificial Sequence
  Synthetic
  misc_feature (1)..(1): inverted abasic cap
  misc_feature (3)..(4): 2'-deoxy
  misc_feature (5)..(5): 2'-O-methyl
  misc_feature (6)..(7): 2'-deoxy
  misc_feature (8)..(8): 2'-deoxy-2'-fluoro
  misc_feature (9)..(9): 2'-deoxy
  misc_feature (10)..(10): 2'-O-methyl
  misc_feature (11)..(12): 2'-deoxy-2'-fluoro
  misc_feature (13)..(13): 2'-O-methyl
  misc_feature (14)..(15): 2'-deoxy
  misc_feature (16)..(16): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2095 - RNA, 21 nt, Artificial Sequence
  Synthetic
  misc_feature (1)..(4): 2'-O-methyl
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2096 - RNA, 21 nt, Artificial Sequence
  Synthetic
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-deoxy
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (8)..(8): 2'-deoxy
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy
  misc_feature (16)..(17): 2'-deoxy
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
cuguuggauugauucgaaauu

SEQ ID NO: 2097 - RNA, 21 nt, Artificial Sequence
  Synthetic
  misc_feature (1)..(3): 2'-O-methyl
  misc_feature (4)..(4): 2'-deoxy-2'-fluoro
  misc_feature (5)..(5): 2'-O-methyl
  misc_feature (6)..(6): 2'-deoxy-2'-fluoro
  misc_feature (8)..(8): 2'-O-methyl
  misc_feature (11)..(12): 2'-deoxy-2'-fluoro
  misc_feature (16)..(16): 2'-deoxy-2'-fluoro
  misc_feature (17)..(21): 2'-O-methyl
  misc_feature (20)..(21): phosphorothioate linkage
uuucgaaucaauccaacaguu

SEQ ID NO: 2098 - RNA, 21 nt, Artificial Sequence
  Synthetic
  misc_feature (1)..(1): inverted abasic cap
  misc_feature (1)..(1): 2'-O-methyl
  misc_feature (2)..(4): 2'-deoxy
  misc_feature (6)..(6): 2'-O-methyl
  misc_feature (7)..(7): 2'-deoxy-2'-fluoro
  misc_feature (8)..(9): 2'-deoxy
  misc_feature (11)..(12): 2'-deoxy
  misc_feature (13)..(13): 2'-O-methyl
  misc_feature (14)..(16): 2'-deoxy
  misc_feature (17)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2099 - RNA, 21 nt, Artificial Sequence
  Synthetic
  misc_feature (1)..(3): 2'-O-methyl
  misc_feature (4)..(6): 2'-deoxy-2'-fluoro
  misc_feature (7)..(7): 2'-O-methyl
  misc_feature (9)..(9): 2'-deoxy-2'-fluoro
  misc_feature (12)..(12): 2'-O-methyl
  misc_feature (13)..(13): 2'-deoxy-2'-fluoro
  misc_feature (15)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2100 - RNA, 21 nt, Artificial Sequence
  Synthetic
  misc_feature (1)..(1): inverted abasic cap
  misc_feature (1)..(2): 2'-deoxy
  misc_feature (3)..(3): 2'-deoxy-2'-fluoro
  misc_feature (4)..(5): 2'-deoxy
  misc_feature (6)..(8): 2'-deoxy-2'-fluoro
  misc_feature (9)..(10): 2'-deoxy
  misc_feature (11)..(12): 2'-deoxy-2'-fluoro
  misc_feature (13)..(15): 2'-deoxy
  misc_feature (16)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
cuguuggauugauucgaaauu

SEQ ID NO: 2101 - RNA, 21 nt, Artificial Sequence
  Synthetic
  misc_feature (1)..(3): 2'-O-methyl
  misc_feature (4)..(4): 2'-deoxy-2'-fluoro
  misc_feature (5)..(5): 2'-O-methyl
  misc_feature (7)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (13)..(13): 2'-O-methyl
  misc_feature (14)..(15): 2'-deoxy-2'-fluoro
  misc_feature (16)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
uuucgaaucaauccaacaguu

SEQ ID NO: 2102 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy
  misc_feature (3)..(3): 2'-O-methyl
  misc_feature (4)..(6): 2'-deoxy
  misc_feature (7)..(7): 2'-O-methyl
  misc_feature (8)..(9): 2'-deoxy-2'-fluoro
  misc_feature (10)..(10): 2'-deoxy
  misc_feature (11)..(11): 2'-deoxy-2'-fluoro
  misc_feature (12)..(12): 2'-deoxy
  misc_feature (14)..(14): 2'-deoxy-2'-fluoro
  misc_feature (17)..(17): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2103 - RNA, 21 nt, Artificial Sequence
  Synthetic
  misc_feature (1)..(1): 2'-O-methyl
  misc_feature (2)..(3): 2'-deoxy-2'-fluoro
  misc_feature (4)..(5): 2'-O-methyl
  misc_feature (8)..(9): 2'-deoxy-2'-fluoro
  misc_feature (10)..(11): 2'-O-methyl
  misc_feature (13)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (19)..(21): 2'-O-methyl
  misc_feature (20)..(21): phosphorothioate linkage
auagcuaggaucauccugguu

SEQ ID NO: 2104 - RNA, 21 nt, Artificial Sequence
  Synthetic
  misc_feature (1)..(1): inverted abasic cap
  misc_feature (1)..(4): 2'-deoxy
  misc_feature (5)..(6): 2'-deoxy-2'-fluoro
  misc_feature (7)..(7): 2'-O-methyl
  misc_feature (8)..(8): 2'-deoxy
  misc_feature (9)..(9): 2'-deoxy-2'-fluoro
  misc_feature (10)..(11): 2'-deoxy
  misc_feature (13)..(13): 2'-deoxy
  misc_feature (14)..(14): 2'-O-methyl
  misc_feature (15)..(15): 2'-deoxy-2'-fluoro
  misc_feature (16)..(18): 2'-deoxy
  misc_feature (19)..(21): 2'-O-methyl
  misc_feature (20)..(21): phosphorothioate linkage
  misc_feature (21)..(21): inverted abasic cap
ccaggaugauccuagcuauuu

SEQ ID NO: 2105 - RNA, 21 nt, Artificial Sequence
  Synthetic
  misc_feature (1)..(3): 2'-O-methyl
  misc_feature (4)..(7): 2'-deoxy-2'-fluoro
  misc_feature (8)..(8): 2'-O-methyl
  misc_feature (9)..(10): 2'-deoxy-2'-fluoro
  misc_feature (11)..(11): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2106 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(5): 2'-O-methyl
  misc_feature (8)..(9): 2'-O-methyl
  misc_feature (10)..(10): 2'-deoxy-2'-fluoro
  misc_feature (12)..(12): 2'-O-methyl
  misc_feature (13)..(16): 2'-deoxy-2'-fluoro
  misc_feature (17)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2107 - RNA, 21 nt, Artificial Sequence
  Synthetic
  misc_feature (1)..(1): inverted abasic cap
  misc_feature (1)..(2): 2'-deoxy
  misc_feature (3)..(4): 2'-deoxy-2'-fluoro
  misc_feature (5)..(5): 2'-O-methyl
  misc_feature (6)..(7): 2'-deoxy
  misc_feature (8)..(8): 2'-deoxy-2'-fluoro
  misc_feature (9)..(9): 2'-deoxy
  misc_feature (10)..(10): 2'-O-methyl
  misc_feature (11)..(12): 2'-deoxy
  misc_feature (13)..(13): 2'-O-methyl
  misc_feature (14)..(16): 2'-deoxy
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
ccaggaugauccuagcuauuu

SEQ ID NO: 2108 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(5): 2'-O-methyl
  misc_feature (6)..(8): 2'-deoxy-2'-fluoro
  misc_feature (10)..(10): 2'-O-methyl
  misc_feature (12)..(12): 2'-O-methyl
  misc_feature (14)..(15): 2'-deoxy-2'-fluoro
  misc_feature (17)..(18): 2'-deoxy-2'-fluoro
  misc_feature (19)..(21): 2'-O-methyl
  misc_feature (20)..(21): phosphorothioate linkage
auagcuaggaucauccugguu

SEQ ID NO: 2109 - RNA, 21 nt, Artificial Sequence
  Synthetic
  misc_feature (1)..(1): inverted abasic cap
  misc_feature (1)..(2): 2'-deoxy
  misc_feature (4)..(4): 2'-O-methyl
  misc_feature (5)..(5): 2'-deoxy
  misc_feature (7)..(8): 2'-deoxy
  misc_feature (9)..(10): 2'-O-methyl
  misc_feature (11)..(11): 2'-deoxy
  misc_feature (13)..(14): 2'-deoxy
  misc_feature (15)..(15): 2'-O-methyl
  misc_feature (16)..(16): 2'-deoxy
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
ccaggaugauccuagcuauuu

SEQ ID NO: 2110 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(4): 2'-deoxy
  misc_feature (5)..(5): 2'-deoxy-2'-fluoro
  misc_feature (6)..(8): 2'-deoxy
  misc_feature (9)..(9): 2'-deoxy-2'-fluoro
  misc_feature (10)..(10): 2'-O-methyl
  misc_feature (12)..(12): 2'-deoxy
  misc_feature (14)..(15): 2'-deoxy-2'-fluoro
  misc_feature (18)..(18): 2'-deoxy
  misc_feature (19)..(21): 2'-O-methyl
  misc_feature (20)..(21): phosphorothioate linkage
  misc_feature (21)..(21): inverted abasic cap
ccaggaugauccuagcuauuu

SEQ ID NO: 2111 - RNA, 21 nt, Artificial Sequence
  Synthetic
  misc_feature (1)..(3): 2'-O-methyl
  misc_feature (5)..(5): 2'-deoxy-2'-fluoro
  misc_feature (8)..(8): 2'-deoxy-2'-fluoro
  misc_feature (9)..(10): 2'-O-methyl
  misc_feature (11)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2112 - RNA, 21 nt, Artificial Sequence
  Synthetic
  misc_feature (1)..(2): 2'-deoxy-2'-fluoro
  misc_feature (3)..(3): 2'-O-methyl
  misc_feature (4)..(4): 2'-deoxy-2'-fluoro
  misc_feature (6)..(6): 2'-O-methyl
  misc_feature (7)..(7): 2'-deoxy-2'-fluoro
  misc_feature (9)..(9): 2'-O-methyl
  misc_feature (11)..(11): 2'-deoxy-2'-fluoro
  misc_feature (12)..(12): 2'-O-methyl
  misc_feature (13)..(14): 2'-deoxy-2'-fluoro
  misc_feature (15)..(15): 2'-O-methyl
  misc_feature (18)..(21): 2'-O-methyl
  misc_feature (20)..(21): phosphorothioate linkage
auagcuaggaucauccugguu

SEQ ID NO: 2113 - RNA, 21 nt, Artificial Sequence
  Synthetic
  misc_feature (1)..(1): inverted abasic cap
  misc_feature (2)..(3): 2'-O-methyl
  misc_feature (4)..(4): 2'-deoxy
  misc_feature (6)..(7): 2'-deoxy
  misc_feature (9)..(11): 2'-deoxy
  misc_feature (12)..(12): 2'-O-methyl
  misc_feature (13)..(13): 2'-deoxy
  misc_feature (14)..(14): 2'-O-methyl
  misc_feature (15)..(15): 2'-deoxy
  misc_feature (17)..(17): 2'-deoxy
  misc_feature (18)..(21): 2'-O-methyl
  misc_feature (20)..(21): phosphorothioate linkage
  misc_feature (21)..(21): inverted abasic cap
ccaggaugauccuagcuauuu

SEQ ID NO: 2114 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(5): 2'-O-methyl
  misc_feature (6)..(9): 2'-deoxy-2'-fluoro
  misc_feature (11)..(11): 2'-O-methyl
  misc_feature (12)..(13): 2'-deoxy-2'-fluoro
  misc_feature (15)..(15): 2'-deoxy-2'-fluoro
  misc_feature (19)..(21): 2'-O-methyl
  misc_feature (20)..(21): phosphorothioate linkage
auagcuaggaucauccugguu

SEQ ID NO: 2115 - RNA, 21 nt, Artificial Sequence
  Synthetic
  misc_feature (1)..(1): inverted abasic cap
  misc_feature (1)..(1): 2'-deoxy
  misc_feature (3)..(5): 2'-deoxy
  misc_feature (6)..(6): 2'-O-methyl
  misc_feature (7)..(11): 2'-deoxy
  misc_feature (12)..(12): 2'-O-methyl
  misc_feature (13)..(13): 2'-deoxy
  misc_feature (14)..(15): 2'-deoxy-2'-fluoro
  misc_feature (16)..(16): 2'-O-methyl
  misc_feature (17)..(17): 2'-deoxy
  misc_feature (18)..(18): 2'-deoxy-2'-fluoro
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2116 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (6)..(7): 2'-O-methyl
  misc_feature (8)..(9): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2117 - RNA, 21 nt, Artificial Sequence
  Synthetic
  misc_feature (1)..(1): inverted abasic cap
  misc_feature (1)..(2): 2'-O-methyl
  misc_feature (3)..(3): 2'-deoxy
  misc_feature (4)..(4): 2'-deoxy-2'-fluoro
  misc_feature (5)..(6): 2'-deoxy
  misc_feature (8)..(9): 2'-deoxy-2'-fluoro
  misc_feature (10)..(10): 2'-deoxy
  misc_feature (11)..(11): 2'-O-methyl
  misc_feature (12)..(13): 2'-deoxy
  misc_feature (14)..(14): 2'-deoxy-2'-fluoro
  misc_feature (15)..(17): 2'-deoxy
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2118 - RNA, 21 nt, Artificial Sequence
  Synthetic
  misc_feature (1)..(1): inverted abasic cap
  misc_feature (1)..(2): 2'-deoxy
  misc_feature (3)..(6): 2'-deoxy-2'-fluoro
  misc_feature (7)..(7): 2'-deoxy
  misc_feature (8)..(9): 2'-deoxy-2'-fluoro
  misc_feature (10)..(13): 2'-deoxy
  misc_feature (14)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2119 - RNA, 21 nt, Artificial Sequence
  Synthetic
  misc_feature (1)..(6): 2'-O-methyl
  misc_feature (7)..(7): 2'-deoxy-2'-fluoro
  misc_feature (8)..(9): 2'-O-methyl
  misc_feature (12)..(14): 2'-deoxy-2'-fluoro
  misc_feature (15)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
auagcuaggaucauccugguu

SEQ ID NO: 2120 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (9)..(9): 2'-O-methyl
  misc_feature (12)..(13): 2'-deoxy-2'-fluoro
  misc_feature (15)..(15): 2'-O-methyl
  misc_feature (17)..(18): 2'-deoxy-2'-fluoro
  misc_feature (19)..(21): 2'-O-methyl
  misc_feature (20)..(21): phosphorothioate linkage
auagcuaggaucauccugguu

SEQ ID NO: 2121 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy
  misc_feature (4)..(4): 2'-deoxy-2'-fluoro
  misc_feature (5)..(6): 2'-O-methyl
  misc_feature (8)..(8): 2'-deoxy
  misc_feature (9)..(10): 2'-O-methyl
  misc_feature (11)..(12): 2'-deoxy
  misc_feature (14)..(14): 2'-deoxy
  misc_feature (16)..(16): 2'-deoxy-2'-fluoro
  misc_feature (17)..(18): 2'-deoxy
  misc_feature (19)..(21): 2'-O-methyl
  misc_feature (20)..(21): phosphorothioate linkage
  misc_feature (21)..(21): inverted abasic cap
ccaggaugauccuagcuauuu

SEQ ID NO: 2122 - RNA, 21 nt, Artificial Sequence
  Synthetic
  misc_feature (1)..(2): 2'-deoxy-2'-fluoro
  misc_feature (3)..(4): 2'-O-methyl
  misc_feature (5)..(5): 2'-deoxy-2'-fluoro
  misc_feature (6)..(6): 2'-O-methyl
  misc_feature (7)..(11): 2'-deoxy-2'-fluoro
  misc_feature (13)..(13): 2'-O-methyl
  misc_feature (16)..(16): 2'-O-methyl
  misc_feature (17)..(17): 2'-deoxy-2'-fluoro
  misc_feature (18)..(18): 2'-O-methyl
  misc_feature (20)..(21): 2'-O-methyl
  misc_feature (20)..(21): phosphorothioate linkage
auagcuaggaucauccugguu

SEQ ID NO: 2123 - RNA, 21 nt, Artificial Sequence
  Synthetic
  misc_feature (1)..(1): inverted abasic cap
  misc_feature (2)..(2): 2'-O-methyl
  misc_feature (3)..(3): 2'-deoxy-2'-fluoro
  misc_feature (4)..(5): 2'-deoxy
  misc_feature (6)..(6): 2'-deoxy-2'-fluoro
  misc_feature (7)..(8): 2'-deoxy
  misc_feature (9)..(9): 2'-O-methyl
  misc_feature (10)..(10): 2'-deoxy
  misc_feature (11)..(11): 2'-O-methyl
  misc_feature (13)..(14): 2'-deoxy
  misc_feature (15)..(15): 2'-O-methyl
  misc_feature (16)..(16): 2'-deoxy
  misc_feature (17)..(17): 2'-O-methyl
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2124 - RNA, 21 nt, Artificial Sequence
  Synthetic
  misc_feature (1)..(1): inverted abasic cap
  misc_feature (2)..(2): 2'-deoxy
  misc_feature (3)..(3): 2'-O-methyl
  misc_feature (5)..(5): 2'-deoxy
  misc_feature (6)..(6): 2'-deoxy-2'-fluoro
  misc_feature (7)..(8): 2'-deoxy
  misc_feature (9)..(9): 2'-deoxy-2'-fluoro
  misc_feature (11)..(11): 2'-deoxy
  misc_feature (12)..(12): 2'-O-methyl
  misc_feature (13)..(13): 2'-deoxy-2'-fluoro
  misc_feature (14)..(14): 2'-deoxy
  misc_feature (15)..(15): 2'-deoxy-2'-fluoro
  misc_feature (16)..(16): 2'-O-methyl
  misc_feature (18)..(18): 2'-deoxy
  misc_feature (19)..(21): 2'-O-methyl
  misc_feature (20)..(21): phosphorothioate linkage
  misc_feature (21)..(21): inverted abasic cap
ccaggaugauccuagcuauuu

SEQ ID NO: 2125 - RNA, 21 nt, Artificial Sequence
  Synthetic
  misc_feature (1)..(4): 2'-O-methyl
  misc_feature (6)..(6): 2'-O-methyl
  misc_feature (8)..(8): 2'-O-methyl
  misc_feature (9)..(10): 2'-deoxy-2'-fluoro
  misc_feature (12)..(12): 2'-O-methyl
  misc_feature (13)..(14): 2'-deoxy-2'-fluoro
  misc_feature (16)..(17): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2126 - RNA, 21 nt, Artificial Sequence
  Synthetic
  misc_feature (1)..(1): inverted abasic cap
  misc_feature (1)..(1): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy
  misc_feature (9)..(9): 2'-O-methyl
  misc_feature (10)..(10): 2'-deoxy-2'-fluoro
  misc_feature (12)..(13): 2'-O-methyl
  misc_feature (14)..(14): 2'-deoxy-2'-fluoro
  misc_feature (15)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2127 - RNA, 21 nt, Artificial Sequence
  Synthetic
  misc_feature (1)..(2): 2'-O-methyl
  misc_feature (3)..(3): 2'-deoxy-2'-fluoro
  misc_feature (7)..(8): 2'-deoxy-2'-fluoro
  misc_feature (9)..(9): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (16)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2128 - RNA, 21 nt, Artificial Sequence
  Synthetic
  misc_feature (1)..(1): 2'-deoxy-2'-fluoro
  misc_feature (2)..(3): 2'-O-methyl
  misc_feature (5)..(5): 2'-O-methyl
  misc_feature (6)..(6): 2'-deoxy-2'-fluoro
  misc_feature (7)..(9): 2'-O-methyl
  misc_feature (11)..(11): 2'-O-methyl
  misc_feature (15)..(15): 2'-O-methyl
  misc_feature (16)..(16): 2'-deoxy-2'-fluoro
  misc_feature (18)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2129 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (6)..(7): 2'-deoxy
  misc_feature (8)..(8): 2'-deoxy-2'-fluoro
  misc_feature (9)..(9): 2'-deoxy
  misc_feature (10)..(10): 2'-deoxy-2'-fluoro
  misc_feature (11)..(11): 2'-O-methyl
  misc_feature (13)..(13): 2'-deoxy
  misc_feature (14)..(14): 2'-O-methyl
  misc_feature (16)..(16): 2'-deoxy-2'-fluoro
  misc_feature (17)..(17): 2'-O-methyl
  misc_feature (18)..(18): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2130 - RNA, 21 nt, Artificial Sequence
  Synthetic
  misc_feature (1)..(1): inverted abasic cap
  misc_feature (1)..(1): 2'-deoxy
  misc_feature (2)..(5): 2'-deoxy-2'-fluoro
  misc_feature (6)..(6): 2'-deoxy
  misc_feature (7)..(9): 2'-deoxy-2'-fluoro
  misc_feature (10)..(10): 2'-deoxy
  misc_feature (12)..(13): 2'-O-methyl
  misc_feature (14)..(15): 2'-deoxy
  misc_feature (16)..(16): 2'-O-methyl
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2131 - RNA, 21 nt, Artificial Sequence
  Synthetic
  misc_feature (1)..(2): 2'-O-methyl
  misc_feature (3)..(3): 2'-deoxy-2'-fluoro
  misc_feature (6)..(6): 2'-deoxy-2'-fluoro
  misc_feature (7)..(7): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(15): 2'-deoxy-2'-fluoro
  misc_feature (16)..(16): 2'-O-methyl
  misc_feature (18)..(19): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2132 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (5)..(5): 2'-deoxy-2'-fluoro
  misc_feature (6)..(6): 2'-O-methyl
  misc_feature (7)..(9): 2'-deoxy-2'-fluoro
  misc_feature (13)..(13): 2'-O-methyl
  misc_feature (14)..(15): 2'-deoxy-2'-fluoro
  misc_feature (18)..(18): 2'-O-methyl
  misc_feature (20)..(21): 2'-O-methyl
  misc_feature (20)..(21): phosphorothioate linkage
auagcuaggaucauccugguu

SEQ ID NO: 2133 - RNA, 21 nt, Artificial Sequence
  Synthetic
  misc_feature (1)..(1): inverted abasic cap
  misc_feature (3)..(3): 2'-O-methyl
  misc_feature (4)..(4): 2'-deoxy-2'-fluoro
  misc_feature (5)..(5): 2'-deoxy
  misc_feature (6)..(6): 2'-deoxy-2'-fluoro
  misc_feature (7)..(7): 2'-O-methyl
  misc_feature (8)..(8): 2'-deoxy
  misc_feature (10)..(10): 2'-O-methyl
  misc_feature (11)..(11): 2'-deoxy-2'-fluoro
  misc_feature (13)..(13): 2'-deoxy
  misc_feature (14)..(14): 2'-deoxy-2'-fluoro
  misc_feature (15)..(16): 2'-deoxy
  misc_feature (17)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2134 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (6)..(6): 2'-deoxy-2'-fluoro
  misc_feature (7)..(8): 2'-O-methyl
  misc_feature (10)..(10): 2'-deoxy-2'-fluoro
  misc_feature (11)..(11): 2'-O-methyl
  misc_feature (13)..(13): 2'-O-methyl
  misc_feature (14)..(14): 2'-deoxy-2'-fluoro
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
auagcuaggaucauccugguu

SEQ ID NO: 2135 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy
  misc_feature (4)..(6): 2'-deoxy-2'-fluoro
  misc_feature (8)..(9): 2'-deoxy
  misc_feature (11)..(11): 2'-O-methyl
  misc_feature (12)..(12): 2'-deoxy
  misc_feature (13)..(13): 2'-O-methyl
  misc_feature (14)..(14): 2'-deoxy
  misc_feature (15)..(15): 2'-deoxy-2'-fluoro
  misc_feature (17)..(17): 2'-O-methyl
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2136 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy
  misc_feature (4)..(4): 2'-deoxy
  misc_feature (5)..(5): 2'-deoxy-2'-fluoro
  misc_feature (6)..(7): 2'-O-methyl
  misc_feature (8)..(8): 2'-deoxy-2'-fluoro
  misc_feature (9)..(10): 2'-deoxy
  misc_feature (11)..(11): 2'-O-methyl
  misc_feature (14)..(15): 2'-deoxy
  misc_feature (16)..(18): 2'-deoxy-2'-fluoro
  misc_feature (20)..(21): 2'-O-methyl
  misc_feature (20)..(21): phosphorothioate linkage
  misc_feature (21)..(21): inverted abasic cap
ccaggaugauccuagcuauuu

SEQ ID NO: 2137 - RNA, 21 nt, Artificial Sequence
  Synthetic
  misc_feature (1)..(1): 2'-O-methyl
  misc_feature (2)..(4): 2'-deoxy-2'-fluoro
  misc_feature (8)..(8): 2'-deoxy-2'-fluoro
  misc_feature (9)..(9): 2'-O-methyl
  misc_feature (10)..(11): 2'-deoxy-2'-fluoro
  misc_feature (12)..(13): 2'-O-methyl
  misc_feature (15)..(15): 2'-deoxy-2'-fluoro
  misc_feature (16)..(16): 2'-O-methyl
  misc_feature (19)..(21): 2'-O-methyl
  misc_feature (20)..(21): phosphorothioate linkage
auagcuaggaucauccugguu

SEQ ID NO: 2138 - RNA, 21 nt, Artificial Sequence
  Synthetic
  misc_feature (1)..(3): 2'-deoxy-2'-fluoro
  misc_feature (4)..(4): 2'-O-methyl
  misc_feature (6)..(6): 2'-deoxy-2'-fluoro
  misc_feature (7)..(7): 2'-O-methyl
  misc_feature (9)..(9): 2'-O-methyl
  misc_feature (10)..(10): 2'-deoxy-2'-fluoro
  misc_feature (12)..(13): 2'-deoxy-2'-fluoro
  misc_feature (15)..(16): 2'-O-methyl
  misc_feature (18)..(18): 2'-deoxy-2'-fluoro
  misc_feature (19)..(21): 2'-O-methyl
  misc_feature (20)..(21): phosphorothioate linkage
aagcaacugaacuagucguuu

SEQ ID NO: 2139 - RNA, 21 nt, Artificial Sequence
  Synthetic
  misc_feature (1)..(1): inverted abasic cap
  misc_feature (1)..(2): 2'-deoxy
  misc_feature (3)..(3): 2'-deoxy-2'-fluoro
  misc_feature (5)..(5): 2'-O-methyl
  misc_feature (6)..(6): 2'-deoxy-2'-fluoro
  misc_feature (7)..(7): 2'-O-methyl
  misc_feature (8)..(8): 2'-deoxy-2'-fluoro
  misc_feature (9)..(10): 2'-deoxy
  misc_feature (11)..(11): 2'-deoxy-2'-fluoro
  misc_feature (13)..(14): 2'-deoxy
  misc_feature (15)..(15): 2'-O-methyl
  misc_feature (16)..(16): 2'-deoxy
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2140 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(8): 2'-O-methyl
  misc_feature (9)..(9): 2'-deoxy-2'-fluoro
  misc_feature (11)..(11): 2'-deoxy-2'-fluoro
  misc_feature (14)..(14): 2'-deoxy-2'-fluoro
  misc_feature (15)..(16): 2'-O-methyl
  misc_feature (18)..(19): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2141 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(3): 2'-deoxy
  misc_feature (4)..(4): 2'-O-methyl
  misc_feature (5)..(5): 2'-deoxy
  misc_feature (7)..(8): 2'-deoxy
  misc_feature (9)..(9): 2'-deoxy-2'-fluoro
  misc_feature (10)..(11): 2'-O-methyl
  misc_feature (13)..(13): 2'-deoxy-2'-fluoro
  misc_feature (14)..(14): 2'-deoxy
  misc_feature (15)..(17): 2'-deoxy-2'-fluoro
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2142 - RNA, 21 nt, Artificial Sequence
  Synthetic
  misc_feature (1)..(1): inverted abasic cap
  misc_feature (1)..(1): 2'-deoxy-2'-fluoro
  misc_feature (3)..(4): 2'-deoxy
  misc_feature (7)..(8): 2'-deoxy-2'-fluoro
  misc_feature (9)..(10): 2'-deoxy
  misc_feature (11)..(11): 2'-O-methyl
  misc_feature (12)..(12): 2'-deoxy-2'-fluoro
  misc_feature (13)..(13): 2'-deoxy
  misc_feature (14)..(15): 2'-O-methyl
  misc_feature (16)..(16): 2'-deoxy-2'-fluoro
  misc_feature (17)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2143 - RNA, 21 nt, Artificial Sequence
  Synthetic
  misc_feature (1)..(3): 2'-O-methyl
  misc_feature (4)..(5): 2'-deoxy-2'-fluoro
  misc_feature (6)..(6): 2'-O-methyl
  misc_feature (8)..(8): 2'-deoxy-2'-fluoro
  misc_feature (9)..(9): 2'-O-methyl
  misc_feature (10)..(11): 2'-deoxy-2'-fluoro
  misc_feature (13)..(13): 2'-O-methyl
  misc_feature (14)..(14): 2'-deoxy-2'-fluoro
  misc_feature (16)..(16): 2'-deoxy-2'-fluoro
  misc_feature (17)..(18): 2'-O-methyl
  misc_feature (20)..(21): 2'-O-methyl
  misc_feature (20)..(21): phosphorothioate linkage
aagcaacugaacuagucguuu

SEQ ID NO: 2144 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (8)..(8): 2'-O-methyl
  misc_feature (11)..(11): 2'-O-methyl
  misc_feature (13)..(13): 2'-O-methyl
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (20)..(21): 2'-O-methyl
  misc_feature (20)..(21): phosphorothioate linkage
aagcaacugaacuagucguuu

SEQ ID NO: 2145 - RNA, 21 nt, Artificial Sequence
  Synthetic
  misc_feature (1)..(1): inverted abasic cap
  misc_feature (1)..(1): 2'-deoxy-2'-fluoro
  misc_feature (3)..(4): 2'-deoxy-2'-fluoro
  misc_feature (6)..(6): 2'-deoxy-2'-fluoro
  misc_feature (7)..(8): 2'-deoxy
  misc_feature (10)..(10): 2'-deoxy-2'-fluoro
  misc_feature (11)..(11): 2'-deoxy
  misc_feature (12)..(12): 2'-O-methyl
  misc_feature (13)..(13): 2'-deoxy-2'-fluoro
  misc_feature (14)..(14): 2'-O-methyl
  misc_feature (15)..(15): 2'-deoxy
  misc_feature (16)..(17): 2'-deoxy-2'-fluoro
  misc_feature (18)..(21): 2'-O-methyl
  misc_feature (20)..(21): phosphorothioate linkage
  misc_feature (21)..(21): inverted abasic cap
acgacuaguucaguugcuuuu

SEQ ID NO: 2146 - RNA, 21 nt, Artificial Sequence
  Synthetic
  misc_feature (1)..(2): 2'-deoxy-2'-fluoro
  misc_feature (3)..(4): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (13)..(15): 2'-deoxy-2'-fluoro
  misc_feature (17)..(17): 2'-deoxy-2'-fluoro
  misc_feature (18)..(21): 2'-O-methyl
  misc_feature (20)..(21): phosphorothioate linkage
aagcaacugaacuagucguuu

SEQ ID NO: 2147 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-O-methyl
  misc_feature (6)..(7): 2'-deoxy
  misc_feature (8)..(9): 2'-deoxy-2'-fluoro
  misc_feature (10)..(10): 2'-O-methyl
  misc_feature (12)..(14): 2'-deoxy
  misc_feature (16)..(16): 2'-deoxy
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2148 - RNA, 21 nt, Artificial Sequence
  Synthetic
  misc_feature (1)..(1): inverted abasic cap
  misc_feature (2)..(3): 2'-deoxy
  misc_feature (4)..(4): 2'-deoxy-2'-fluoro
  misc_feature (6)..(7): 2'-O-methyl
  misc_feature (8)..(8): 2'-deoxy
  misc_feature (10)..(10): 2'-deoxy
  misc_feature (11)..(11): 2'-O-methyl
  misc_feature (12)..(12): 2'-deoxy
  misc_feature (13)..(15): 2'-O-methyl
  misc_feature (16)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2149 - RNA, 21 nt, Artificial Sequence
  Synthetic
  misc_feature (1)..(2): 2'-O-methyl
  misc_feature (3)..(3): 2'-deoxy-2'-fluoro
  misc_feature (5)..(5): 2'-O-methyl
  misc_feature (7)..(7): 2'-deoxy-2'-fluoro
  misc_feature (8)..(8): 2'-O-methyl
  misc_feature (10)..(10): 2'-deoxy-2'-fluoro
  misc_feature (11)..(11): 2'-O-methyl
  misc_feature (13)..(13): 2'-O-methyl
  misc_feature (14)..(14): 2'-deoxy-2'-fluoro
  misc_feature (16)..(16): 2'-O-methyl
  misc_feature (17)..(18): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2150 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy-2'-fluoro
  misc_feature (4)..(5): 2'-deoxy
  misc_feature (6)..(6): 2'-O-methyl
  misc_feature (7)..(7): 2'-deoxy
  misc_feature (8)..(8): 2'-O-methyl
  misc_feature (10)..(10): 2'-deoxy
  misc_feature (12)..(12): 2'-deoxy-2'-fluoro
  misc_feature (13)..(13): 2'-deoxy
  misc_feature (14)..(14): 2'-O-methyl
  misc_feature (15)..(16): 2'-deoxy
  misc_feature (17)..(17): 2'-deoxy-2'-fluoro
  misc_feature (18)..(18): 2'-deoxy
  misc_feature (19)..(21): 2'-O-methyl
  misc_feature (20)..(21): phosphorothioate linkage
  misc_feature (21)..(21): inverted abasic cap
acgacuaguucaguugcuuuu

SEQ ID NO: 2151 - RNA, 21 nt, Artificial Sequence
  Synthetic
  misc_feature (1)..(2): 2'-O-methyl
  misc_feature (3)..(3): 2'-deoxy-2'-fluoro
  misc_feature (4)..(5): 2'-O-methyl
  misc_feature (6)..(9): 2'-deoxy-2'-fluoro
  misc_feature (11)..(11): 2'-O-methyl
  misc_feature (12)..(12): 2'-deoxy-2'-fluoro
  misc_feature (14)..(15): 2'-deoxy-2'-fluoro
  misc_feature (16)..(16): 2'-O-methyl
  misc_feature (19)..(21): 2'-O-methyl
  misc_feature (20)..(21): phosphorothioate linkage
aagcaacugaacuagucguuu

SEQ ID NO: 2152 - RNA, 21 nt, Artificial Sequence
  Synthetic
  misc_feature (1)..(1): inverted abasic cap
  misc_feature (1)..(2): 2'-deoxy-2'-fluoro
  misc_feature (3)..(3): 2'-O-methyl
  misc_feature (4)..(4): 2'-deoxy
  misc_feature (5)..(6): 2'-O-methyl
  misc_feature (7)..(8): 2'-deoxy-2'-fluoro
  misc_feature (9)..(9): 2'-deoxy
  misc_feature (12)..(13): 2'-deoxy-2'-fluoro
  misc_feature (14)..(14): 2'-deoxy
  misc_feature (15)..(15): 2'-deoxy-2'-fluoro
  misc_feature (17)..(17): 2'-O-methyl
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2153 - RNA, 21 nt, Artificial Sequence
  Synthetic
  misc_feature (1)..(1): 2'-O-methyl
  misc_feature (2)..(4): 2'-deoxy-2'-fluoro
  misc_feature (6)..(6): 2'-deoxy-2'-fluoro
  misc_feature (9)..(11): 2'-deoxy-2'-fluoro
  misc_feature (12)..(12): 2'-O-methyl
  misc_feature (16)..(18): 2'-deoxy-2'-fluoro
  misc_feature (19)..(21): 2'-O-methyl
  misc_feature (20)..(21): phosphorothioate linkage
aagcaacugaacuagucguuu

SEQ ID NO: 2154 - RNA, 21 nt, Artificial Sequence
  Synthetic
  misc_feature (1)..(1): inverted abasic cap
  misc_feature (1)..(1): 2'-deoxy-2'-fluoro
  misc_feature (3)..(4): 2'-deoxy
  misc_feature (5)..(5): 2'-deoxy-2'-fluoro
  misc_feature (6)..(6): 2'-deoxy
  misc_feature (7)..(7): 2'-O-methyl
  misc_feature (8)..(10): 2'-deoxy
  misc_feature (11)..(12): 2'-O-methyl
  misc_feature (13)..(14): 2'-deoxy
  misc_feature (16)..(16): 2'-deoxy-2'-fluoro
  misc_feature (17)..(21): 2'-O-methyl
  misc_feature (20)..(21): phosphorothioate linkage
  misc_feature (21)..(21): inverted abasic cap
acgacuaguucaguugcuuuu

SEQ ID NO: 2155 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(3): 2'-O-methyl
  misc_feature (5)..(5): 2'-deoxy-2'-fluoro
  misc_feature (7)..(7): 2'-deoxy-2'-fluoro
  misc_feature (8)..(8): 2'-O-methyl
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (17)..(17): 2'-deoxy-2'-fluoro
  misc_feature (18)..(21): 2'-O-methyl
  misc_feature (20)..(21): phosphorothioate linkage
aagcaacugaacuagucguuu

SEQ ID NO: 2156 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(4): 2'-deoxy
  misc_feature (5)..(5): 2'-O-methyl
  misc_feature (6)..(6): 2'-deoxy
  misc_feature (7)..(7): 2'-deoxy-2'-fluoro
  misc_feature (8)..(8): 2'-deoxy
  misc_feature (10)..(11): 2'-deoxy
  misc_feature (12)..(12): 2'-deoxy-2'-fluoro
  misc_feature (13)..(15): 2'-deoxy
  misc_feature (16)..(16): 2'-deoxy-2'-fluoro
  misc_feature (17)..(17): 2'-deoxy
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2157 - RNA, 21 nt, Artificial Sequence
  Synthetic
  misc_feature (1)..(2): 2'-O-methyl
  misc_feature (3)..(6): 2'-deoxy-2'-fluoro
  misc_feature (8)..(10): 2'-O-methyl
  misc_feature (13)..(14): 2'-deoxy-2'-fluoro
  misc_feature (15)..(21): 2'-O-methyl
  misc_feature (20)..(21): phosphorothioate linkage
aagcaacugaacuagucguuu

SEQ ID NO: 2158 - RNA, 21 nt, Artificial Sequence
  Synthetic
  misc_feature (1)..(1): inverted abasic cap
  misc_feature (1)..(1): 2'-deoxy
  misc_feature (2)..(3): 2'-O-methyl
  misc_feature (4)..(4): 2'-deoxy-2'-fluoro
  misc_feature (7)..(7): 2'-deoxy-2'-fluoro
  misc_feature (8)..(9): 2'-deoxy
  misc_feature (10)..(10): 2'-O-methyl
  misc_feature (11)..(12): 2'-deoxy
  misc_feature (13)..(13): 2'-O-methyl
  misc_feature (14)..(14): 2'-deoxy
  misc_feature (15)..(15): 2'-O-methyl
  misc_feature (16)..(16): 2'-deoxy
  misc_feature (17)..(17): 2'-deoxy-2'-fluoro
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2159 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(4): 2'-O-methyl
  misc_feature (7)..(7): 2'-O-methyl
  misc_feature (9)..(10): 2'-deoxy-2'-fluoro
  misc_feature (11)..(13): 2'-O-methyl
  misc_feature (15)..(15): 2'-O-methyl
  misc_feature (16)..(16): 2'-deoxy-2'-fluoro
  misc_feature (17)..(18): 2'-O-methyl
  misc_feature (20)..(21): 2'-O-methyl
  misc_feature (20)..(21): phosphorothioate linkage
aagcaacugaacuagucguuu

SEQ ID NO: 2160 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(8): 2'-O-methyl
  misc_feature (10)..(10): 2'-O-methyl
  misc_feature (11)..(12): 2'-deoxy-2'-fluoro
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy-2'-fluoro
  misc_feature (18)..(18): 2'-deoxy-2'-fluoro
  misc_feature (19)..(21): 2'-O-methyl
  misc_feature (20)..(21): phosphorothioate linkage
aagcaacugaacuagucguuu

SEQ ID NO: 2161 - RNA, 21 nt, Artificial Sequence
  Synthetic
  misc_feature (1)..(1): inverted abasic cap
  misc_feature (1)..(2): 2'-deoxy
  misc_feature (3)..(3): 2'-deoxy-2'-fluoro
  misc_feature (4)..(5): 2'-deoxy
  misc_feature (6)..(6): 2'-O-methyl
  misc_feature (7)..(7): 2'-deoxy
  misc_feature (8)..(8): 2'-deoxy-2'-fluoro
  misc_feature (9)..(12): 2'-deoxy
  misc_feature (13)..(13): 2'-deoxy-2'-fluoro
  misc_feature (14)..(15): 2'-deoxy
  misc_feature (16)..(16): 2'-deoxy-2'-fluoro
  misc_feature (19)..(21): 2'-O-methyl
  misc_feature (20)..(21): phosphorothioate linkage
  misc_feature (21)..(21): inverted abasic cap
acgacuaguucaguugcuuuu

SEQ ID NO: 2162 - RNA, 21 nt, Artificial Sequence
  Synthetic
  misc_feature (1)..(1): inverted abasic cap
  misc_feature (1)..(3): 2'-deoxy
  misc_feature (4)..(4): 2'-deoxy-2'-fluoro
  misc_feature (5)..(5): 2'-O-methyl
  misc_feature (7)..(7): 2'-deoxy-2'-fluoro
  misc_feature (8)..(8): 2'-deoxy
  misc_feature (9)..(9): 2'-deoxy-2'-fluoro
  misc_feature (11)..(11): 2'-deoxy
  misc_feature (12)..(13): 2'-deoxy-2'-fluoro
  misc_feature (14)..(14): 2'-O-methyl
  misc_feature (16)..(16): 2'-deoxy
  misc_feature (17)..(17): 2'-O-methyl
  misc_feature (19)..(21): 2'-O-methyl
  misc_feature (20)..(21): phosphorothioate linkage
  misc_feature (21)..(21): inverted abasic cap
acgacuaguucaguugcuuuu

SEQ ID NO: 2163 - RNA, 21 nt, Artificial Sequence
  Synthetic
  misc_feature (1)..(2): 2'-O-methyl
  misc_feature (3)..(3): 2'-deoxy-2'-fluoro
  misc_feature (4)..(5): 2'-O-methyl
  misc_feature (8)..(9): 2'-O-methyl
  misc_feature (10)..(10): 2'-deoxy-2'-fluoro
  misc_feature (11)..(13): 2'-O-methyl
  misc_feature (14)..(14): 2'-deoxy-2'-fluoro
  misc_feature (17)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2164 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(4): 2'-O-methyl
  misc_feature (6)..(6): 2'-deoxy-2'-fluoro
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(14): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2165 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy
  misc_feature (4)..(4): 2'-deoxy-2'-fluoro
  misc_feature (5)..(6): 2'-deoxy
  misc_feature (7)..(7): 2'-deoxy-2'-fluoro
  misc_feature (8)..(8): 2'-deoxy
  misc_feature (9)..(10): 2'-O-methyl
  misc_feature (12)..(14): 2'-deoxy-2'-fluoro
  misc_feature (16)..(16): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2166 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (6)..(7): 2'-O-methyl
  misc_feature (8)..(9): 2'-deoxy-2'-fluoro
  misc_feature (10)..(10): 2'-O-methyl
  misc_feature (12)..(12): 2'-O-methyl
  misc_feature (13)..(16): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2167 - RNA, 21 nt, Artificial Sequence
  Synthetic
  misc_feature (1)..(1): inverted abasic cap
  misc_feature (1)..(1): 2'-O-methyl
  misc_feature (2)..(2): 2'-deoxy
  misc_feature (5)..(5): 2'-deoxy
  misc_feature (6)..(6): 2'-O-methyl
  misc_feature (7)..(8): 2'-deoxy
  misc_feature (9)..(9): 2'-O-methyl
  misc_feature (11)..(15): 2'-deoxy
  misc_feature (16)..(16): 2'-O-methyl
  misc_feature (17)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2168 - RNA, 21 nt, Artificial Sequence
  Synthetic
  misc_feature (1)..(1): 2'-deoxy-2'-fluoro
  misc_feature (2)..(3): 2'-O-methyl
  misc_feature (5)..(5): 2'-O-methyl
  misc_feature (6)..(7): 2'-deoxy-2'-fluoro
  misc_feature (9)..(10): 2'-deoxy-2'-fluoro
  misc_feature (12)..(13): 2'-O-methyl
  misc_feature (14)..(14): 2'-deoxy-2'-fluoro
  misc_feature (15)..(16): 2'-O-methyl
  misc_feature (17)..(17): 2'-deoxy-2'-fluoro
  misc_feature (19)..(21): 2'-O-methyl
  misc_feature (20)..(21): phosphorothioate linkage
aagcaacugaacuagucguuu

SEQ ID NO: 2169 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(4): 2'-deoxy-2'-fluoro
  misc_feature (5)..(8): 2'-deoxy
  misc_feature (9)..(9): 2'-O-methyl
  misc_feature (11)..(11): 2'-deoxy
  misc_feature (12)..(12): 2'-deoxy-2'-fluoro
  misc_feature (13)..(13): 2'-deoxy
  misc_feature (15)..(16): 2'-deoxy
  misc_feature (17)..(17): 2'-O-methyl
  misc_feature (18)..(18): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2170 - RNA, 21 nt, Artificial Sequence
  Synthetic
  misc_feature (1)..(1): inverted abasic cap
  misc_feature (1)..(1): 2'-deoxy
  misc_feature (3)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(11): 2'-O-methyl
  misc_feature (12)..(12): 2'-deoxy
  misc_feature (13)..(13): 2'-deoxy-2'-fluoro
  misc_feature (15)..(17): 2'-deoxy
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2171 - RNA, 21 nt, Artificial Sequence
  Synthetic
  misc_feature (1)..(3): 2'-O-methyl
  misc_feature (5)..(6): 2'-O-methyl
  misc_feature (7)..(7): 2'-deoxy-2'-fluoro
  misc_feature (8)..(8): 2'-O-methyl
  misc_feature (11)..(11): 2'-deoxy-2'-fluoro
  misc_feature (12)..(12): 2'-O-methyl
  misc_feature (14)..(14): 2'-deoxy-2'-fluoro
  misc_feature (15)..(15): 2'-O-methyl
  misc_feature (17)..(17): 2'-O-methyl
  misc_feature (19)..(19): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2172 - RNA, 21 nt, Artificial Sequence
  Synthetic
  misc_feature (1)..(2): 2'-deoxy-2'-fluoro
  misc_feature (3)..(4): 2'-O-methyl
  misc_feature (6)..(7): 2'-O-methyl
  misc_feature (8)..(8): 2'-deoxy-2'-fluoro
  misc_feature (9)..(9): 2'-O-methyl
  misc_feature (10)..(10): 2'-deoxy-2'-fluoro
  misc_feature (11)..(12): 2'-O-methyl
  misc_feature (14)..(15): 2'-deoxy-2'-fluoro
  misc_feature (16)..(16): 2'-O-methyl
  misc_feature (17)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 2173 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(6): 2'-deoxy
  misc_feature (7)..(8): 2'-deoxy-2'-fluoro
  misc_feature (9)..(11): 2'-deoxy
  misc_feature (12)..(13): 2'-deoxy-2'-fluoro
  misc_feature (14)..(15): 2'-deoxy
  misc_feature (16)..(16): 2'-deoxy-2'-fluoro
  misc_feature (17)..(19): 2'-deoxy
  misc_feature (20)..(21): 2'-O-methyl
  misc_feature (20)..(21): phosphorothioate linkage
  misc_feature (21)..(21): inverted abasic cap
acgacuaguucaguugcuuuu

SEQ ID NO: 2174 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(6): 2'-deoxy-2'-fluoro
  misc_feature (7)..(7): 2'-O-methyl
  misc_feature (8)..(8): 2'-deoxy-2'-fluoro
  misc_feature (10)..(10): 2'-O-methyl
  misc_feature (11)..(11): 2'-deoxy-2'-fluoro
  misc_feature (12)..(13): 2'-O-methyl
  misc_feature (14)..(14): 2'-deoxy-2'-fluoro
  misc_feature (15)..(15): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2175 - RNA, 21 nt, Artificial Sequence
  Synthetic
  misc_feature (1)..(2): 2'-O-methyl
  misc_feature (3)..(4): 2'-deoxy-2'-fluoro
  misc_feature (5)..(5): 2'-O-methyl
  misc_feature (7)..(7): 2'-O-methyl
  misc_feature (8)..(9): 2'-deoxy-2'-fluoro
  misc_feature (10)..(10): 2'-O-methyl
  misc_feature (12)..(14): 2'-deoxy-2'-fluoro
  misc_feature (17)..(17): 2'-O-methyl
  misc_feature (19)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2176 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (4)..(5): 2'-O-methyl
  misc_feature (6)..(10): 2'-deoxy-2'-fluoro
  misc_feature (11)..(11): 2'-O-methyl
  misc_feature (15)..(15): 2'-deoxy-2'-fluoro
  misc_feature (16)..(16): 2'-O-methyl
  misc_feature (18)..(18): 2'-O-methyl
  misc_feature (20)..(21): 2'-O-methyl
  misc_feature (20)..(21): phosphorothioate linkage
acgauagcuaggaucauccuu

SEQ ID NO: 2177 - RNA, 21 nt, Artificial Sequence
  Synthetic
  misc_feature (1)..(1): inverted abasic cap
  misc_feature (1)..(1): 2'-deoxy
  misc_feature (2)..(2): 2'-deoxy-2'-fluoro
  misc_feature (3)..(3): 2'-O-methyl
  misc_feature (5)..(5): 2'-deoxy
  misc_feature (6)..(6): 2'-deoxy-2'-fluoro
  misc_feature (8)..(8): 2'-O-methyl
  misc_feature (10)..(13): 2'-deoxy-2'-fluoro
  misc_feature (14)..(14): 2'-O-methyl
  misc_feature (15)..(15): 2'-deoxy
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
ggaugauccuagcuaucguuu

SEQ ID NO: 2178 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(5): 2'-deoxy-2'-fluoro
  misc_feature (6)..(6): 2'-O-methyl
  misc_feature (9)..(9): 2'-deoxy-2'-fluoro
  misc_feature (11)..(11): 2'-deoxy-2'-fluoro
  misc_feature (13)..(13): 2'-deoxy-2'-fluoro
  misc_feature (15)..(17): 2'-deoxy-2'-fluoro
  misc_feature (19)..(21): 2'-O-methyl
  misc_feature (20)..(21): phosphorothioate linkage
acgauagcuaggaucauccuu

SEQ ID NO: 2179 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(3): 2'-deoxy
  misc_feature (4)..(4): 2'-O-methyl
  misc_feature (5)..(5): 2'-deoxy-2'-fluoro
  misc_feature (6)..(8): 2'-O-methyl
  misc_feature (10)..(10): 2'-deoxy
  misc_feature (11)..(11): 2'-O-methyl
  misc_feature (12)..(12): 2'-deoxy
  misc_feature (14)..(15): 2'-deoxy-2'-fluoro
  misc_feature (16)..(17): 2'-deoxy
  misc_feature (18)..(21): 2'-O-methyl
  misc_feature (20)..(21): phosphorothioate linkage
  misc_feature (21)..(21): inverted abasic cap
ggaugauccuagcuaucguuu

SEQ ID NO: 2180 - RNA, 21 nt, Artificial Sequence
  Synthetic
  misc_feature (1)..(3): 2'-deoxy-2'-fluoro
  misc_feature (7)..(7): 2'-O-methyl
  misc_feature (9)..(9): 2'-O-methyl
  misc_feature (10)..(10): 2'-deoxy-2'-fluoro
  misc_feature (11)..(11): 2'-O-methyl
  misc_feature (12)..(12): 2'-deoxy-2'-fluoro
  misc_feature (13)..(13): 2'-O-methyl
  misc_feature (15)..(16): 2'-O-methyl
  misc_feature (17)..(17): 2'-deoxy-2'-fluoro
  misc_feature (19)..(21): 2'-O-methyl
  misc_feature (20)..(21): phosphorothioate linkage
acgauagcuaggaucauccuu

SEQ ID NO: 2181 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-O-methyl
  misc_feature (3)..(3): 2'-deoxy
  misc_feature (4)..(4): 2'-O-methyl
  misc_feature (5)..(5): 2'-deoxy
  misc_feature (10)..(11): 2'-deoxy
  misc_feature (12)..(12): 2'-deoxy-2'-fluoro
  misc_feature (13)..(13): 2'-O-methyl
  misc_feature (14)..(14): 2'-deoxy
  misc_feature (15)..(16): 2'-deoxy-2'-fluoro
  misc_feature (17)..(18): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2182 - RNA, 21 nt, Artificial Sequence
  Synthetic
  misc_feature (1)..(1): inverted abasic cap
  misc_feature (1)..(3): 2'-deoxy-2'-fluoro
  misc_feature (4)..(4): 2'-deoxy
  misc_feature (5)..(6): 2'-deoxy-2'-fluoro
  misc_feature (7)..(10): 2'-deoxy
  misc_feature (11)..(12): 2'-deoxy-2'-fluoro
  misc_feature (13)..(14): 2'-deoxy
  misc_feature (15)..(15): 2'-deoxy-2'-fluoro
  misc_feature (16)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2183 - RNA, 21 nt, Artificial Sequence
  Synthetic
  misc_feature (1)..(2): 2'-O-methyl
  misc_feature (3)..(4): 2'-deoxy-2'-fluoro
  misc_feature (5)..(6): 2'-O-methyl
  misc_feature (7)..(7): 2'-deoxy-2'-fluoro
  misc_feature (8)..(9): 2'-O-methyl
  misc_feature (10)..(10): 2'-deoxy-2'-fluoro
  misc_feature (11)..(12): 2'-O-methyl
  misc_feature (14)..(14): 2'-deoxy-2'-fluoro
  misc_feature (15)..(17): 2'-O-methyl
  misc_feature (19)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2184 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(5): 2'-deoxy-2'-fluoro
  misc_feature (7)..(7): 2'-deoxy-2'-fluoro
  misc_feature (9)..(10): 2'-O-methyl
  misc_feature (11)..(12): 2'-deoxy-2'-fluoro
  misc_feature (13)..(13): 2'-O-methyl
  misc_feature (14)..(16): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2185 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (3)..(3): 2'-deoxy-2'-fluoro
  misc_feature (4)..(8): 2'-deoxy
  misc_feature (10)..(12): 2'-deoxy
  misc_feature (13)..(13): 2'-O-methyl
  misc_feature (15)..(15): 2'-deoxy-2'-fluoro
  misc_feature (16)..(16): 2'-O-methyl
  misc_feature (17)..(17): 2'-deoxy
  misc_feature (18)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2186 - RNA, 21 nt, Artificial Sequence
  Synthetic
  misc_feature (1)..(1): 2'-deoxy-2'-fluoro
  misc_feature (2)..(4): 2'-O-methyl
  misc_feature (5)..(6): 2'-deoxy-2'-fluoro
  misc_feature (8)..(8): 2'-O-methyl
  misc_feature (9)..(9): 2'-deoxy-2'-fluoro
  misc_feature (11)..(13): 2'-O-methyl
  misc_feature (14)..(14): 2'-deoxy-2'-fluoro
  misc_feature (16)..(16): 2'-deoxy-2'-fluoro
  misc_feature (17)..(18): 2'-O-methyl
  misc_feature (20)..(21): 2'-O-methyl
  misc_feature (20)..(21): phosphorothioate linkage
acgauagcuaggaucauccuu

SEQ ID NO: 2187 - RNA, 21 nt, Artificial Sequence
  Synthetic
  misc_feature (1)..(1): inverted abasic cap
  misc_feature (1)..(2): 2'-deoxy
  misc_feature (3)..(3): 2'-deoxy-2'-fluoro
  misc_feature (4)..(4): 2'-deoxy
  misc_feature (5)..(5): 2'-O-methyl
  misc_feature (6)..(6): 2'-deoxy
  misc_feature (7)..(7): 2'-O-methyl
  misc_feature (8)..(8): 2'-deoxy
  misc_feature (9)..(9): 2'-O-methyl
  misc_feature (10)..(10): 2'-deoxy
  misc_feature (11)..(11): 2'-deoxy-2'-fluoro
  misc_feature (12)..(14): 2'-deoxy
  misc_feature (18)..(18): 2'-deoxy-2'-fluoro
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2188 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(3): 2'-deoxy-2'-fluoro
  misc_feature (5)..(5): 2'-deoxy-2'-fluoro
  misc_feature (6)..(7): 2'-deoxy
  misc_feature (8)..(9): 2'-O-methyl
  misc_feature (10)..(10): 2'-deoxy
  misc_feature (11)..(11): 2'-deoxy-2'-fluoro
  misc_feature (12)..(12): 2'-deoxy
  misc_feature (14)..(15): 2'-deoxy
  misc_feature (17)..(18): 2'-deoxy
  misc_feature (19)..(21): 2'-O-methyl
  misc_feature (20)..(21): phosphorothioate linkage
  misc_feature (21)..(21): inverted abasic cap
ggaugauccuagcuaucguuu

SEQ ID NO: 2189 - RNA, 21 nt, Artificial Sequence
  Synthetic
  misc_feature (1)..(3): 2'-O-methyl
  misc_feature (5)..(5): 2'-deoxy-2'-fluoro
  misc_feature (7)..(8): 2'-deoxy-2'-fluoro
  misc_feature (10)..(10): 2'-deoxy-2'-fluoro
  misc_feature (11)..(11): 2'-O-methyl
  misc_feature (13)..(13): 2'-O-methyl
  misc_feature (15)..(15): 2'-O-methyl
  misc_feature (16)..(17): 2'-deoxy-2'-fluoro
  misc_feature (18)..(18): 2'-O-methyl
  misc_feature (20)..(21): 2'-O-methyl
  misc_feature (20)..(21): phosphorothioate linkage
acgauagcuaggaucauccuu

SEQ ID NO: 2190 - RNA, 21 nt, Artificial Sequence
  Synthetic
  misc_feature (1)..(1): 2'-deoxy-2'-fluoro
  misc_feature (2)..(4): 2'-O-methyl
  misc_feature (5)..(6): 2'-deoxy-2'-fluoro
  misc_feature (7)..(8): 2'-O-methyl
  misc_feature (11)..(11): 2'-O-methyl
  misc_feature (12)..(12): 2'-deoxy-2'-fluoro
  misc_feature (15)..(15): 2'-O-methyl
  misc_feature (16)..(16): 2'-deoxy-2'-fluoro
  misc_feature (18)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2191 - RNA, 21 nt, Artificial Sequence
  Synthetic
  misc_feature (1)..(1): inverted abasic cap
  misc_feature (2)..(2): 2'-deoxy-2'-fluoro
  misc_feature (3)..(5): 2'-deoxy
  misc_feature (6)..(7): 2'-deoxy-2'-fluoro
  misc_feature (8)..(8): 2'-deoxy
  misc_feature (9)..(9): 2'-O-methyl
  misc_feature (11)..(12): 2'-deoxy
  misc_feature (15)..(16): 2'-O-methyl
  misc_feature (17)..(17): 2'-deoxy
  misc_feature (18)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2192 - RNA, 21 nt, Artificial Sequence
  Synthetic
  misc_feature (1)..(1): inverted abasic cap
  misc_feature (1)..(1): 2'-O-methyl
  misc_feature (2)..(3): 2'-deoxy-2'-fluoro
  misc_feature (4)..(4): 2'-O-methyl
  misc_feature (5)..(5): 2'-deoxy-2'-fluoro
  misc_feature (6)..(6): 2'-deoxy
  misc_feature (8)..(8): 2'-O-methyl
  misc_feature (9)..(9): 2'-deoxy-2'-fluoro
  misc_feature (11)..(12): 2'-deoxy-2'-fluoro
  misc_feature (13)..(14): 2'-deoxy
  misc_feature (15)..(15): 2'-deoxy-2'-fluoro
  misc_feature (16)..(16): 2'-O-methyl
  misc_feature (18)..(18): 2'-deoxy
  misc_feature (19)..(19): 2'-deoxy-2'-fluoro
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2193 - RNA, 21 nt, Artificial Sequence
  Synthetic
  misc_feature (1)..(4): 2'-O-methyl
  misc_feature (5)..(5): 2'-deoxy-2'-fluoro
  misc_feature (6)..(6): 2'-O-methyl
  misc_feature (7)..(7): 2'-deoxy-2'-fluoro
  misc_feature (9)..(9): 2'-O-methyl
  misc_feature (10)..(11): 2'-deoxy-2'-fluoro
  misc_feature (14)..(14): 2'-deoxy-2'-fluoro
  misc_feature (15)..(15): 2'-O-methyl
  misc_feature (18)..(18): 2'-O-methyl
  misc_feature (19)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2194 - RNA, 21 nt, Artificial Sequence
  Synthetic
  misc_feature (1)..(1): inverted abasic cap
  misc_feature (1)..(3): 2'-deoxy
  misc_feature (5)..(5): 2'-deoxy
  misc_feature (6)..(6): 2'-deoxy-2'-fluoro
  misc_feature (7)..(7): 2'-deoxy
  misc_feature (8)..(8): 2'-O-methyl
  misc_feature (9)..(9): 2'-deoxy
  misc_feature (11)..(11): 2'-deoxy-2'-fluoro
  misc_feature (12)..(14): 2'-O-methyl
  misc_feature (15)..(15): 2'-deoxy-2'-fluoro
  misc_feature (16)..(16): 2'-O-methyl
  misc_feature (17)..(18): 2'-deoxy-2'-fluoro
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2195 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(3): 2'-O-methyl
  misc_feature (6)..(6): 2'-O-methyl
  misc_feature (9)..(11): 2'-O-methyl
  misc_feature (12)..(16): 2'-deoxy-2'-fluoro
  misc_feature (17)..(17): 2'-O-methyl
  misc_feature (19)..(21): 2'-O-methyl
  misc_feature (20)..(21): phosphorothioate linkage
acgauagcuaggaucauccuu

SEQ ID NO: 2196 - RNA, 21 nt, Artificial Sequence
  Synthetic
  misc_feature (1)..(3): 2'-deoxy-2'-fluoro
  misc_feature (4)..(4): 2'-O-methyl
  misc_feature (5)..(6): 2'-deoxy-2'-fluoro
  misc_feature (7)..(9): 2'-O-methyl
  misc_feature (10)..(11): 2'-deoxy-2'-fluoro
  misc_feature (12)..(12): 2'-O-methyl
  misc_feature (13)..(14): 2'-deoxy-2'-fluoro
  misc_feature (18)..(18): 2'-deoxy-2'-fluoro
  misc_feature (19)..(21): 2'-O-methyl
  misc_feature (20)..(21): phosphorothioate linkage
acgauagcuaggaucauccuu

SEQ ID NO: 2197 - RNA, 21 nt, Artificial Sequence
  Synthetic
  misc_feature (1)..(1): inverted abasic cap
  misc_feature (1)..(1): 2'-deoxy
  misc_feature (2)..(2): 2'-deoxy-2'-fluoro
  misc_feature (3)..(6): 2'-deoxy
  misc_feature (7)..(7): 2'-O-methyl
  misc_feature (9)..(10): 2'-O-methyl
  misc_feature (11)..(12): 2'-deoxy-2'-fluoro
  misc_feature (13)..(14): 2'-deoxy
  misc_feature (15)..(15): 2'-O-methyl
  misc_feature (16)..(17): 2'-deoxy
  misc_feature (18)..(18): 2'-O-methyl
  misc_feature (19)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2198 - RNA, 21 nt, Artificial Sequence
  Synthetic
  misc_feature (1)..(1): 2'-deoxy-2'-fluoro
  misc_feature (2)..(2): 2'-O-methyl
  misc_feature (3)..(3): 2'-deoxy-2'-fluoro
  misc_feature (6)..(8): 2'-deoxy-2'-fluoro
  misc_feature (10)..(12): 2'-O-methyl
  misc_feature (14)..(14): 2'-deoxy-2'-fluoro
  misc_feature (17)..(17): 2'-deoxy-2'-fluoro
  misc_feature (18)..(21): 2'-O-methyl
  misc_feature (20)..(21): phosphorothioate linkage
acgauagcuaggaucauccuu

SEQ ID NO: 2199 - RNA, 21 nt, Artificial Sequence
  Synthetic
  misc_feature (1)..(1): inverted abasic cap
  misc_feature (1)..(1): 2'-deoxy
  misc_feature (2)..(2): 2'-O-methyl
  misc_feature (4)..(5): 2'-deoxy
  misc_feature (6)..(6): 2'-O-methyl
  misc_feature (7)..(7): 2'-deoxy-2'-fluoro
  misc_feature (8)..(8): 2'-O-methyl
  misc_feature (9)..(10): 2'-deoxy
  misc_feature (11)..(11): 2'-deoxy-2'-fluoro
  misc_feature (12)..(12): 2'-O-methyl
  misc_feature (13)..(13): 2'-deoxy
  misc_feature (16)..(16): 2'-deoxy
  misc_feature (17)..(17): 2'-O-methyl
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2200 - RNA, 21 nt, Artificial Sequence
  Synthetic
  misc_feature (1)..(1): 2'-deoxy-2'-fluoro
  misc_feature (2)..(4): 2'-O-methyl
  misc_feature (6)..(6): 2'-deoxy-2'-fluoro
  misc_feature (7)..(8): 2'-O-methyl
  misc_feature (9)..(9): 2'-deoxy-2'-fluoro
  misc_feature (10)..(10): 2'-O-methyl
  misc_feature (12)..(12): 2'-O-methyl
  misc_feature (13)..(14): 2'-deoxy-2'-fluoro
  misc_feature (15)..(15): 2'-O-methyl
  misc_feature (16)..(17): 2'-deoxy-2'-fluoro
  misc_feature (18)..(21): 2'-O-methyl
  misc_feature (20)..(21): phosphorothioate linkage
acgauagcuaggaucauccuu

SEQ ID NO: 2201 - RNA, 21 nt, Artificial Sequence
  Synthetic
  misc_feature (1)..(1): inverted abasic cap
  misc_feature (1)..(1): 2'-deoxy
  misc_feature (2)..(3): 2'-deoxy-2'-fluoro
  misc_feature (4)..(4): 2'-O-methyl
  misc_feature (5)..(5): 2'-deoxy
  misc_feature (6)..(6): 2'-deoxy-2'-fluoro
  misc_feature (7)..(9): 2'-deoxy
  misc_feature (10)..(11): 2'-O-methyl
  misc_feature (12)..(12): 2'-deoxy-2'-fluoro
  misc_feature (13)..(18): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2202 - RNA, 21 nt, Artificial Sequence
  Synthetic
  misc_feature (1)..(1): 2'-deoxy-2'-fluoro
  misc_feature (2)..(3): 2'-O-methyl
  misc_feature (4)..(4): 2'-deoxy-2'-fluoro
  misc_feature (5)..(5): 2'-O-methyl
  misc_feature (6)..(8): 2'-deoxy-2'-fluoro
  misc_feature (11)..(11): 2'-deoxy-2'-fluoro
  misc_feature (15)..(15): 2'-deoxy-2'-fluoro
  misc_feature (16)..(16): 2'-O-methyl
  misc_feature (17)..(17): 2'-deoxy-2'-fluoro
  misc_feature (19)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2203 - RNA, 21 nt, Artificial Sequence
  Synthetic
  misc_feature (1)..(1): inverted abasic cap
  misc_feature (1)..(1): 2'-O-methyl
  misc_feature (2)..(3): 2'-deoxy
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): 2'-deoxy
  misc_feature (9)..(9): 2'-deoxy
  misc_feature (10)..(10): 2'-O-methyl
  misc_feature (11)..(11): 2'-deoxy
  misc_feature (12)..(13): 2'-deoxy-2'-fluoro
  misc_feature (15)..(16): 2'-deoxy
  misc_feature (17)..(17): 2'-O-methyl
  misc_feature (18)..(18): 2'-deoxy-2'-fluoro
  misc_feature (19)..(21): 2'-O-methyl
  misc_feature (20)..(21): phosphorothioate linkage
  misc_feature (21)..(21): inverted abasic cap
ggaugauccuagcuaucguuu

SEQ ID NO: 2204 - RNA, 21 nt, Artificial Sequence
  Synthetic
  misc_feature (1)..(1): inverted abasic cap
  misc_feature (1)..(1): 2'-O-methyl
  misc_feature (3)..(3): 2'-deoxy-2'-fluoro
  misc_feature (5)..(6): 2'-deoxy-2'-fluoro
  misc_feature (7)..(7): 2'-deoxy
  misc_feature (8)..(9): 2'-O-methyl
  misc_feature (10)..(10): 2'-deoxy-2'-fluoro
  misc_feature (11)..(12): 2'-deoxy
  misc_feature (13)..(13): 2'-O-methyl
  misc_feature (14)..(14): 2'-deoxy-2'-fluoro
  misc_feature (15)..(15): 2'-O-methyl
  misc_feature (16)..(16): 2'-deoxy
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2205 - RNA, 21 nt, Artificial Sequence
  Synthetic
  misc_feature (1)..(1): 2'-O-methyl
  misc_feature (2)..(2): 2'-deoxy-2'-fluoro
  misc_feature (3)..(3): 2'-O-methyl
  misc_feature (6)..(6): 2'-deoxy-2'-fluoro
  misc_feature (7)..(8): 2'-O-methyl
  misc_feature (10)..(10): 2'-deoxy-2'-fluoro
  misc_feature (13)..(14): 2'-deoxy-2'-fluoro
  misc_feature (16)..(17): 2'-O-methyl
  misc_feature (18)..(19): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2206 - RNA, 21 nt, Artificial Sequence
  Synthetic
  misc_feature (1)..(1): inverted abasic cap
  misc_feature (2)..(2): 2'-deoxy
  misc_feature (3)..(4): 2'-O-methyl
  misc_feature (6)..(10): 2'-deoxy
  misc_feature (11)..(12): 2'-deoxy-2'-fluoro
  misc_feature (14)..(15): 2'-O-methyl
  misc_feature (16)..(16): 2'-deoxy-2'-fluoro
  misc_feature (17)..(17): 2'-O-methyl
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2207 - RNA, 21 nt, Artificial Sequence
  Synthetic
  misc_feature (1)..(1): 2'-O-methyl
  misc_feature (2)..(4): 2'-deoxy-2'-fluoro
  misc_feature (5)..(5): 2'-O-methyl
  misc_feature (6)..(7): 2'-deoxy-2'-fluoro
  misc_feature (9)..(10): 2'-O-methyl
  misc_feature (12)..(13): 2'-O-methyl
  misc_feature (15)..(15): 2'-deoxy-2'-fluoro
  misc_feature (17)..(18): 2'-deoxy-2'-fluoro
  misc_feature (20)..(21): 2'-O-methyl
  misc_feature (20)..(21): phosphorothioate linkage
acgauagcuaggaucauccuu

SEQ ID NO: 2208 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(4): 2'-deoxy
  misc_feature (5)..(6): 2'-deoxy-2'-fluoro
  misc_feature (8)..(9): 2'-deoxy
  misc_feature (11)..(13): 2'-deoxy
  misc_feature (14)..(14): 2'-O-methyl
  misc_feature (15)..(15): 2'-deoxy-2'-fluoro
  misc_feature (16)..(16): 2'-deoxy
  misc_feature (17)..(17): 2'-O-methyl
  misc_feature (18)..(19): 2'-deoxy
  misc_feature (20)..(21): 2'-O-methyl
  misc_feature (20)..(21): phosphorothioate linkage
  misc_feature (21)..(21): inverted abasic cap
ggaugauccuagcuaucguuu

SEQ ID NO: 2209 - RNA, 21 nt, Artificial Sequence
  Synthetic
  misc_feature (1)..(3): 2'-O-methyl
  misc_feature (4)..(4): 2'-deoxy-2'-fluoro
  misc_feature (5)..(6): 2'-O-methyl
  misc_feature (8)..(12): 2'-deoxy-2'-fluoro
  misc_feature (13)..(13): 2'-O-methyl
  misc_feature (14)..(14): 2'-deoxy-2'-fluoro
  misc_feature (16)..(16): 2'-O-methyl
  misc_feature (18)..(18): 2'-deoxy-2'-fluoro
  misc_feature (19)..(21): 2'-O-methyl
  misc_feature (20)..(21): phosphorothioate linkage
acgauagcuaggaucauccuu

SEQ ID NO: 2210 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(3): 2'-O-methyl
  misc_feature (4)..(5): 2'-deoxy-2'-fluoro
  misc_feature (6)..(8): 2'-O-methyl
  misc_feature (9)..(10): 2'-deoxy-2'-fluoro
  misc_feature (11)..(12): 2'-O-methyl
  misc_feature (13)..(15): 2'-deoxy-2'-fluoro
  misc_feature (16)..(19): 2'-O-methyl
  misc_feature (21)..(21): inverted abasic cap
cuguuggauugauucgaaatt

SEQ ID NO: 2211 - RNA, 21 nt, Artificial Sequence
  Synthetic
  misc_feature (1)..(1): Inosine
  misc_feature (4)..(4): 2'-deoxy-2'-fluoro
  misc_feature (5)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
nuucgaaucaauccaacaguu

SEQ ID NO: 2212 - RNA, 21 nt, Artificial Sequence
  Synthetic
  misc_feature (2)..(2): Inosine
  misc_feature (4)..(4): 2'-deoxy-2'-fluoro
  misc_feature (5)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
unucgaaucaauccaacaguu

SEQ ID NO: 2213 - RNA, 21 nt, Artificial Sequence
  Synthetic
  misc_feature (3)..(3): Inosine
  misc_feature (4)..(4): 2'-deoxy-2'-fluoro
  misc_feature (5)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
uuncgaaucaauccaacaguu

SEQ ID NO: 2214 - RNA, 21 nt, Artificial Sequence
  Synthetic
  misc_feature (4)..(4): Inosine
  misc_feature (5)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
uuungaaucaauccaacaguu

SEQ ID NO: 2215 - RNA, 21 nt, Artificial Sequence
  Synthetic
  misc_feature (4)..(4): 2'-deoxy-2'-fluoro
  misc_feature (5)..(5): Inosine
  misc_feature (6)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
uuucnaaucaauccaacaguu

SEQ ID NO: 2216 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): Inosine
  misc_feature (7)..(7): 2'-O-methyl
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
uuucgnaucaauccaacaguu

SEQ ID NO: 2217 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(7): Inosine
  misc_feature (8)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
uuucganucaauccaacaguu

SEQ ID NO: 2218 - RNA, 21 nt, Artificial Sequence
  Synthetic
  misc_feature (4)..(4): 2'-deoxy-2'-fluoro
  misc_feature (5)..(7): 2'-O-methyl
  misc_feature (8)..(8): Inosine
  misc_feature (9)..(9): 2'-deoxy-2'-fluoro
  misc_feature (10)..(11): 2'-O-methyl
  misc_feature (12)..(14): 2'-deoxy-2'-fluoro
  misc_feature (15)..(16): 2'-O-methyl
  misc_feature (17)..(17): 2'-deoxy-2'-fluoro
  misc_feature (18)..(21): 2'-O-methyl
uuucgaancaauccaacaguu

SEQ ID NO: 2219 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(1): 2'-O-methyl
  misc_feature (2)..(2): 2'-deoxy-2'-fluoro
  misc_feature (3)..(4): 2'-O-methyl
  misc_feature (5)..(6): 2'-deoxy-2'-fluoro
  misc_feature (7)..(8): 2'-O-methyl
  misc_feature (9)..(11): 2'-deoxy-2'-fluoro
  misc_feature (12)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (21)..(21): inverted abasic cap
acgacuaguucaguugcuutt

SEQ ID NO: 2220 - RNA, 21 nt, Artificial Sequence
  Synthetic
  misc_feature (1)..(1): Inosine
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
nagcaacugaacuagucguuu

SEQ ID NO: 2221 - RNA, 21 nt, Artificial Sequence
  Synthetic
  misc_feature (2)..(2): Inosine
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
angcaacugaacuagucguuu

SEQ ID NO: 2222 - RNA, 21 nt, Artificial Sequence
  Synthetic
  misc_feature (3)..(3): Inosine
  misc_feature (4)..(4): 2'-deoxy-2'-fluoro
  misc_feature (5)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aancaacugaacuagucguuu

SEQ ID NO: 2223 - RNA, 21 nt, Artificial Sequence
  Synthetic
  misc_feature (4)..(4): Inosine
  misc_feature (5)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aagnaacugaacuagucguuu

SEQ ID NO: 2224 - RNA, 21 nt, Artificial Sequence
  Synthetic
  misc_feature (4)..(4): 2'-deoxy-2'-fluoro
  misc_feature (5)..(5): Inosine
  misc_feature (6)..(6): 2'-O-methyl
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aagcnacugaacuagucguuu

SEQ ID NO: 2225 - RNA, 21 nt, Artificial Sequence
  Synthetic
  misc_feature (4)..(4): 2'-deoxy-2'-fluoro
  misc_feature (5)..(5): 2'-O-methyl
  misc_feature (6)..(6): Inosine
  misc_feature (7)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aagcancugaacuagucguuu

SEQ ID NO: 2226 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(7): Inosine
  misc_feature (8)..(8): 2'-deoxy-2'-fluoro
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aagcaanugaacuagucguuu

SEQ ID NO: 2227 - RNA, 21 nt, Artificial Sequence
  Synthetic
  misc_feature (4)..(4): 2'-deoxy-2'-fluoro
  misc_feature (5)..(6): 2'-O-methyl
  misc_feature (7)..(7): 2'-deoxy-2'-fluoro
  misc_feature (8)..(8): Inosine
  misc_feature (9)..(11): 2'-O-methyl
  misc_feature (12)..(13): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (20)..(21): 2'-O-methyl
aagcaacngaacuagucguuu

SEQ ID NO: 2228 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(2): 2'-deoxy-2'-fluoro
  misc_feature (3)..(6): 2'-O-methyl
  misc_feature (7)..(7): 2'-deoxy-2'-fluoro
  misc_feature (8)..(9): 2'-O-methyl
  misc_feature (10)..(13): 2'-deoxy-2'-fluoro
  misc_feature (14)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (21)..(21): inverted abasic cap
ccaggaugauccuagcuautt

SEQ ID NO: 2229 - RNA, 21 nt, Artificial Sequence
  Synthetic
  misc_feature (1)..(1): Inosine
  misc_feature (4)..(4): 2'-O-methyl
  misc_feature (5)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
nuagcuaggaucauccugguu

SEQ ID NO: 2230 - RNA, 21 nt, Artificial Sequence
  Synthetic
  misc_feature (2)..(2): Inosine
  misc_feature (4)..(4): 2'-O-methyl
  misc_feature (5)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
anagcuaggaucauccugguu

SEQ ID NO: 2231 - RNA, 21 nt, Artificial Sequence
  Synthetic
  misc_feature (3)..(3): Inosine
  misc_feature (4)..(4): 2'-O-methyl
  misc_feature (5)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
aungcuaggaucauccugguu

SEQ ID NO: 2232 - RNA, 21 nt, Artificial Sequence
  Synthetic
  misc_feature (4)..(4): Inosine
  misc_feature (5)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
auancuaggaucauccugguu

SEQ ID NO: 2233 - RNA, 21 nt, Artificial Sequence
  Synthetic
  misc_feature (4)..(4): 2'-O-methyl
  misc_feature (5)..(5): Inosine
  misc_feature (6)..(6): 2'-deoxy-2'-fluoro
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
auagnuaggaucauccugguu

SEQ ID NO: 2234 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): Inosine
  misc_feature (7)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
auagcnaggaucauccugguu

SEQ ID NO: 2235 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): Inosine
  misc_feature (8)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
auagcunggaucauccugguu

SEQ ID NO: 2236 - RNA, 21 nt, Artificial Sequence
  Synthetic
  misc_feature (4)..(4): 2'-O-methyl
  misc_feature (5)..(6): 2'-deoxy-2'-fluoro
  misc_feature (7)..(7): 2'-O-methyl
  misc_feature (8)..(8): Inosine
  misc_feature (9)..(10): 2'-O-methyl
  misc_feature (11)..(12): 2'-deoxy-2'-fluoro
  misc_feature (13)..(13): 2'-O-methyl
  misc_feature (14)..(17): 2'-deoxy-2'-fluoro
  misc_feature (18)..(21): 2'-O-methyl
auagcuangaucauccugguu

SEQ ID NO: 2237 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (1)..(3): 2'-O-methyl
  misc_feature (4)..(4): 2'-deoxy-2'-fluoro
  misc_feature (5)..(6): 2'-O-methyl
  misc_feature (7)..(10): 2'-deoxy-2'-fluoro
  misc_feature (11)..(12): 2'-O-methyl
  misc_feature (13)..(14): 2'-deoxy-2'-fluoro
  misc_feature (15)..(15): 2'-O-methyl
  misc_feature (16)..(17): 2'-deoxy-2'-fluoro
  misc_feature (18)..(18): 2'-O-methyl
  misc_feature (19)..(19): 2'-deoxy-2'-fluoro
  misc_feature (21)..(21): inverted abasic cap
ggaugauccuagcuaucgutt

SEQ ID NO: 2238 - RNA, 21 nt, Artificial Sequence
  Synthetic
  misc_feature (1)..(1): Inosine
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
ncgauagcuaggaucauccuu

SEQ ID NO: 2239 - RNA, 21 nt, Artificial Sequence
  Synthetic
  misc_feature (2)..(2): Inosine
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
angauagcuaggaucauccuu

SEQ ID NO: 2240 - RNA, 21 nt, Artificial Sequence
  Synthetic
  misc_feature (3)..(3): Inosine
  misc_feature (4)..(4): 2'-O-methyl
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
acnauagcuaggaucauccuu

SEQ ID NO: 2241 - RNA, 21 nt, Artificial Sequence
  Synthetic
  misc_feature (4)..(4): Inosine
  misc_feature (5)..(5): 2'-deoxy-2'-fluoro
  misc_feature (6)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
acgnuagcuaggaucauccuu

SEQ ID NO: 2242 - RNA, 21 nt, Artificial Sequence
  Synthetic
  misc_feature (4)..(4): 2'-O-methyl
  misc_feature (5)..(5): Inosine
  misc_feature (6)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
acganagcuaggaucauccuu

SEQ ID NO: 2243 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): Inosine
  misc_feature (7)..(7): 2'-O-methyl
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
acgaungcuaggaucauccuu

SEQ ID NO: 2244 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(6): 2'-O-methyl
  misc_feature (7)..(7): Inosine
  misc_feature (8)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
acgauancuaggaucauccuu

SEQ ID NO: 2245 - RNA, 21 nt, Artificial Sequence
  Synthetic
  misc_feature (4)..(4): 2'-O-methyl
  misc_feature (5)..(5): 2'-deoxy-2'-fluoro
  misc_feature (6)..(7): 2'-O-methyl
  misc_feature (8)..(8): Inosine
  misc_feature (9)..(9): 2'-deoxy-2'-fluoro
  misc_feature (10)..(13): 2'-O-methyl
  misc_feature (14)..(15): 2'-deoxy-2'-fluoro
  misc_feature (16)..(16): 2'-O-methyl
  misc_feature (17)..(19): 2'-deoxy-2'-fluoro
  misc_feature (20)..(21): 2'-O-methyl
acgauagnuaggaucauccuu

SEQ ID NO: 2246 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauccaagucaacgucuugtt

SEQ ID NO: 2247 - RNA, 21 nt, Artificial Sequence
  Synthetic
  misc_feature (20)..(21): 2'-O-methyl
caagacguugacuuggaucuu

SEQ ID NO: 2248 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaucaugcguucuccucatt

SEQ ID NO: 2249 - RNA, 21 nt, Artificial Sequence
  Synthetic
  misc_feature (20)..(21): 2'-O-methyl
ugaggagaacgcaugauaguu

SEQ ID NO: 2250 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauauaaugaggaccuauatt

SEQ ID NO: 2251 - RNA, 21 nt, Artificial Sequence
  Synthetic
  misc_feature (20)..(21): 2'-O-methyl
uauagguccucauuauauuuu

SEQ ID NO: 2252 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcuaucugucugcucuatt

SEQ ID NO: 2253 - RNA, 21 nt, Artificial Sequence
  Synthetic
  misc_feature (20)..(21): 2'-O-methyl
uagagcagacagauagcacuu

SEQ ID NO: 2254 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagcuuccagacacgcuatt

SEQ ID NO: 2255 - RNA, 21 nt, Artificial Sequence
  Synthetic
  misc_feature (20)..(21): 2'-O-methyl
uagcgugucuggaagcuucuu

SEQ ID NO: 2256 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaauuauaagaacaagaugtt

SEQ ID NO: 2257 - RNA, 21 nt, Artificial Sequence
  Synthetic
  misc_feature (20)..(21): 2'-O-methyl
caucuuguucuuauaauuauu

SEQ ID NO: 2258 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auacaaaugauguagaaactt

SEQ ID NO: 2259 - RNA, 21 nt, Artificial Sequence
  Synthetic
  misc_feature (20)..(21): 2'-O-methyl
guuucuacaucauuuguauuu

SEQ ID NO: 2260 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugucugcucuaguaauaatt

SEQ ID NO: 2261 - RNA, 21 nt, Artificial Sequence
  Synthetic
  misc_feature (20)..(21): 2'-O-methyl
uuauuacuagagcagacaguu

SEQ ID NO: 2262 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcuauuguacguaccaugtt

SEQ ID NO: 2263 - RNA, 21 nt, Artificial Sequence
  Synthetic
  misc_feature (20)..(21): 2'-O-methyl
caugguacguacaauagcauu

SEQ ID NO: 2264 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcugaaggugcuaucugutt

SEQ ID NO: 2265 - RNA, 21 nt, Artificial Sequence
  Synthetic
  misc_feature (20)..(21): 2'-O-methyl
acagauagcaccuucagcauu

SEQ ID NO: 2266 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuuuaguaaauauaaugatt

SEQ ID NO: 2267 - RNA, 21 nt, Artificial Sequence
  Synthetic
  misc_feature (20)..(21): 2'-O-methyl
ucauuauauuuacuaaagcuu

SEQ ID NO: 2268 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuuuaagucuggaggcautt

SEQ ID NO: 2269 - RNA, 21 nt, Artificial Sequence
  Synthetic
  misc_feature (20)..(21): 2'-O-methyl
augccuccagacuuaaagauu

SEQ ID NO: 2270 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaccauuccauuguuugutt

SEQ ID NO: 2271 - RNA, 21 nt, Artificial Sequence
  Synthetic
  misc_feature (20)..(21): 2'-O-methyl
acaaacaauggaaugguauuu

SEQ ID NO: 2272 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggcuacuguuggauugautt

SEQ ID NO: 2273 - RNA, 21 nt, Artificial Sequence
  Synthetic
  misc_feature (20)..(21): 2'-O-methyl
aucaauccaacaguagccuuu

SEQ ID NO: 2274 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguuaugguccaucagcutt

SEQ ID NO: 2275 - RNA, 21 nt, Artificial Sequence
  Synthetic
  misc_feature (20)..(21): 2'-O-methyl
agcugauggaccauaacuguu

SEQ ID NO: 2276 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaagaugauggucugccatt

SEQ ID NO: 2277 - RNA, 21 nt, Artificial Sequence
  Synthetic
  misc_feature (20)..(21): 2'-O-methyl
uggcagaccaucaucuuguuu

SEQ ID NO: 2278 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacauaugcagcugcuguutt

SEQ ID NO: 2279 - RNA, 21 nt, Artificial Sequence
  Synthetic
  misc_feature (20)..(21): 2'-O-methyl
aacagcagcugcauaugucuu

SEQ ID NO: 2280 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guugcuuguucgugcacautt

SEQ ID NO: 2281 - RNA, 21 nt, Artificial Sequence
  Synthetic
  misc_feature (20)..(21): 2'-O-methyl
augugcacgaacaagcaacuu

SEQ ID NO: 2282 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaucaucgugagggcuuatt

SEQ ID NO: 2283 - RNA, 21 nt, Artificial Sequence
  Synthetic
  misc_feature (20)..(21): 2'-O-methyl
uaagcccucacgaugaugguu

SEQ ID NO: 2284 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacagauccaagucaacgutt

SEQ ID NO: 2285 - RNA, 21 nt, Artificial Sequence
  Synthetic
  misc_feature (20)..(21): 2'-O-methyl
acguugacuuggaucugucuu

SEQ ID NO: 2286 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagacauuagaugagggcatt

SEQ ID NO: 2287 - RNA, 21 nt, Artificial Sequence
  Synthetic
  misc_feature (20)..(21): 2'-O-methyl
ugcccucaucuaaugucucuu

SEQ ID NO: 2288 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucgccuucacuauggacutt

SEQ ID NO: 2289 - RNA, 21 nt, Artificial Sequence
  Synthetic
  misc_feature (20)..(21): 2'-O-methyl
aguccauagugaaggcgaauu

SEQ ID NO: 2290 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguucagcuucuggguucatt

SEQ ID NO: 2291 - RNA, 21 nt, Artificial Sequence
  Synthetic
  misc_feature (20)..(21): 2'-O-methyl
ugaacccagaagcugaacauu

SEQ ID NO: 2292 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucuuggacuugauauuggtt

SEQ ID NO: 2293 - RNA, 21 nt, Artificial Sequence
  Synthetic
  misc_feature (20)..(21): 2'-O-methyl
ccaauaucaaguccaagauuu

SEQ ID NO: 2294 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgugcaaucccugaacugatt

SEQ ID NO: 2295 - RNA, 21 nt, Artificial Sequence
  Synthetic
  misc_feature (20)..(21): 2'-O-methyl
ucaguucagggauugcacguu

SEQ ID NO: 2296 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agguggugguuaauaaggctt

SEQ ID NO: 2297 - RNA, 21 nt, Artificial Sequence
  Synthetic
  misc_feature (20)..(21): 2'-O-methyl
gccuuauuaaccaccaccuuu

SEQ ID NO: 2298 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuacacaguuugaugcugtt

SEQ ID NO: 2299 - RNA, 21 nt, Artificial Sequence
  Synthetic
  misc_feature (20)..(21): 2'-O-methyl
cagcaucaaacuguguagauu

SEQ ID NO: 2300 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agauggcccagaaugcagutt

SEQ ID NO: 2301 - RNA, 21 nt, Artificial Sequence
  Synthetic
  misc_feature (20)..(21): 2'-O-methyl
acugcauucugggccaucuuu

SEQ ID NO: 2302 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagauuacaagaaacggctt

SEQ ID NO: 2303 - RNA, 21 nt, Artificial Sequence
  Synthetic
  misc_feature (20)..(21): 2'-O-methyl
gccguuucuuguaaucuuguu

SEQ ID NO: 2304 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucgaaaucuugcccuuugutt

SEQ ID NO: 2305 - RNA, 21 nt, Artificial Sequence
  Synthetic
  misc_feature (20)..(21): 2'-O-methyl
acaaagggcaagauuucgauu

SEQ ID NO: 2306 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugaaacaugcaguuguaatt

SEQ ID NO: 2307 - RNA, 21 nt, Artificial Sequence
  Synthetic
  misc_feature (20)..(21): 2'-O-methyl
uuacaacugcauguuucaguu

SEQ ID NO: 2308 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuccuucucugagugguaatt

SEQ ID NO: 2309 - RNA, 21 nt, Artificial Sequence
  Synthetic
  misc_feature (20)..(21): 2'-O-methyl
uuaccacucagagaaggaguu

SEQ ID NO: 2310 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcaagcucaucauacuggtt

SEQ ID NO: 2311 - RNA, 21 nt, Artificial Sequence
  Synthetic
  misc_feature (20)..(21): 2'-O-methyl
ccaguaugaugagcuugcuuu

SEQ ID NO: 2312 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuauaagaacaagaugautt

SEQ ID NO: 2313 - RNA, 21 nt, Artificial Sequence
  Synthetic
  misc_feature (20)..(21): 2'-O-methyl
aucaucuuguucuuauaauuu

SEQ ID NO: 2314 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucccaucuacacaguuugtt

SEQ ID NO: 2315 - RNA, 21 nt, Artificial Sequence
  Synthetic
  misc_feature (20)..(21): 2'-O-methyl
caaacuguguagaugggauuu

SEQ ID NO: 2316 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugucugcucuaguaauatt

SEQ ID NO: 2317 - RNA, 21 nt, Artificial Sequence
  Synthetic
  misc_feature (20)..(21): 2'-O-methyl
uauuacuagagcagacagauu

SEQ ID NO: 2318 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcuuuaguaaauauaautt

SEQ ID NO: 2319 - RNA, 21 nt, Artificial Sequence
  Synthetic
  misc_feature (20)..(21): 2'-O-methyl
auuauauuuacuaaagcuuuu

SEQ ID NO: 2320 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccggcuauuguagaagcutt

SEQ ID NO: 2321 - RNA, 21 nt, Artificial Sequence
  Synthetic
  misc_feature (20)..(21): 2'-O-methyl
agcuucuacaauagccggcuu

SEQ ID NO: 2322 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugucugcucuaguaauaagtt

SEQ ID NO: 2323 - RNA, 21 nt, Artificial Sequence
  Synthetic
  misc_feature (20)..(21): 2'-O-methyl
cuuauuacuagagcagacauu

SEQ ID NO: 2324 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauaauuauaagaacaagatt

SEQ ID NO: 2325 - RNA, 21 nt, Artificial Sequence
  Synthetic
  misc_feature (20)..(21): 2'-O-methyl
ucuuguucuuauaauuauuuu

SEQ ID NO: 2326 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauggccaggaugccuuggtt

SEQ ID NO: 2327 - RNA, 21 nt, Artificial Sequence
  Synthetic
  misc_feature (20)..(21): 2'-O-methyl
ccaaggcauccuggccauauu

SEQ ID NO: 2328 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugucccgcaaaucaugcactt

SEQ ID NO: 2329 - RNA, 21 nt, Artificial Sequence
  Synthetic
  misc_feature (20)..(21): 2'-O-methyl
gugcaugauuugcgggacauu

SEQ ID NO: 2330 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuguucagaacugucuuutt

SEQ ID NO: 2331 - RNA, 21 nt, Artificial Sequence
  Synthetic
  misc_feature (20)..(21): 2'-O-methyl
aaagacaguucugaacaaguu

SEQ ID NO: 2332 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugugauacgaugcuucatt

SEQ ID NO: 2333 - RNA, 21 nt, Artificial Sequence
  Synthetic
  misc_feature (20)..(21): 2'-O-methyl
ugaagcaucguaucacagcuu

SEQ ID NO: 2334 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcgccguacguccaugggutt

SEQ ID NO: 2335 - RNA, 21 nt, Artificial Sequence
  Synthetic
  misc_feature (20)..(21): 2'-O-methyl
acccauggacguacggcgcuu

SEQ ID NO: 2336 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agauggugucugcuauugutt

SEQ ID NO: 2337 - RNA, 21 nt, Artificial Sequence
  Synthetic
  misc_feature (20)..(21): 2'-O-methyl
acaauagcagacaccaucuuu

SEQ ID NO: 2338 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaacugucuuuggacucutt

SEQ ID NO: 2339 - RNA, 21 nt, Artificial Sequence
  Synthetic
  misc_feature (20)..(21): 2'-O-methyl
agaguccaaagacaguucuuu

SEQ ID NO: 2340 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caugcagaucccaucuacatt

SEQ ID NO: 2341 - RNA, 21 nt, Artificial Sequence
  Synthetic
  misc_feature (20)..(21): 2'-O-methyl
uguagaugggaucugcauguu

SEQ ID NO: 2342 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuccuugggacucuuguuctt

SEQ ID NO: 2343 - RNA, 21 nt, Artificial Sequence
  Synthetic
  misc_feature (20)..(21): 2'-O-methyl
gaacaagagucccaaggaguu

SEQ ID NO: 2344 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugccacuaccacagcuctt

SEQ ID NO: 2345 - RNA, 21 nt, Artificial Sequence
  Synthetic
  misc_feature (20)..(21): 2'-O-methyl
gagcugugguaguggcaccuu

SEQ ID NO: 2346 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcugguggaaugcaagcutt

SEQ ID NO: 2347 - RNA, 21 nt, Artificial Sequence
  Synthetic
  misc_feature (20)..(21): 2'-O-methyl
agcuugcauuccaccagcuuu

SEQ ID NO: 2348 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccauuccacgacuaguucatt

SEQ ID NO: 2349 - RNA, 21 nt, Artificial Sequence
  Synthetic
  misc_feature (20)..(21): 2'-O-methyl
ugaacuagucguggaaugguu

SEQ ID NO: 2350 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagcguuuggcugaaccautt

SEQ ID NO: 2351 - RNA, 21 nt, Artificial Sequence
  Synthetic
  misc_feature (20)..(21): 2'-O-methyl
augguucagccaaacgcuguu

SEQ ID NO: 2352 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucuuuaagucuggaggcatt

SEQ ID NO: 2353 - RNA, 21 nt, Artificial Sequence
  Synthetic
  misc_feature (20)..(21): 2'-O-methyl
ugccuccagacuuaaagauuu

SEQ ID NO: 2354 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggccaggaugccuugggutt

SEQ ID NO: 2355 - RNA, 21 nt, Artificial Sequence
  Synthetic
  misc_feature (20)..(21): 2'-O-methyl
acccaaggcauccuggccauu

SEQ ID NO: 2356 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaauacaaaugauguagaatt

SEQ ID NO: 2357 - RNA, 21 nt, Artificial Sequence
  Synthetic
  misc_feature (20)..(21): 2'-O-methyl
uucuacaucauuuguauucuu

SEQ ID NO: 2358 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaugggcugccuccaggtt

SEQ ID NO: 2359 - RNA, 21 nt, Artificial Sequence
  Synthetic
  misc_feature (20)..(21): 2'-O-methyl
ccuggaggcagcccauccauu

SEQ ID NO: 2360 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cguacguccaugggugggatt

SEQ ID NO: 2361 - RNA, 21 nt, Artificial Sequence
  Synthetic
  misc_feature (20)..(21): 2'-O-methyl
ucccacccauggacguacguu

SEQ ID NO: 2362 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugucugcuauuguacgutt

SEQ ID NO: 2363 - RNA, 21 nt, Artificial Sequence
  Synthetic
  misc_feature (20)..(21): 2'-O-methyl
acguacaauagcagacaccuu

SEQ ID NO: 2364 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugcuaucugucugcucutt

SEQ ID NO: 2365 - RNA, 21 nt, Artificial Sequence
  Synthetic
  misc_feature (20)..(21): 2'-O-methyl
agagcagacagauagcaccuu

SEQ ID NO: 2366 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuucacuauggacuaccatt

SEQ ID NO: 2367 - RNA, 21 nt, Artificial Sequence
  Synthetic
  misc_feature (20)..(21): 2'-O-methyl
ugguaguccauagugaagguu

SEQ ID NO: 2368 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacucuuguucagcuucugtt

SEQ ID NO: 2369 - RNA, 21 nt, Artificial Sequence
  Synthetic
  misc_feature (20)..(21): 2'-O-methyl
cagaagcugaacaagagucuu

SEQ ID NO: 2370 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucuacacaguuugaugcutt

SEQ ID NO: 2371 - RNA, 21 nt, Artificial Sequence
  Synthetic
  misc_feature (20)..(21): 2'-O-methyl
agcaucaaacuguguagauuu

SEQ ID NO: 2372 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuugugcagcugcuuuautt

SEQ ID NO: 2373 - RNA, 21 nt, Artificial Sequence
  Synthetic
  misc_feature (20)..(21): 2'-O-methyl
auaaagcagcugcacaaacuu

SEQ ID NO: 2374 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagaaacggcuuucaguutt

SEQ ID NO: 2375 - RNA, 21 nt, Artificial Sequence
  Synthetic
  misc_feature (20)..(21): 2'-O-methyl
aacugaaagccguuucuuguu

SEQ ID NO: 2376 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucaguugcuuguucgugtt

SEQ ID NO: 2377 - RNA, 21 nt, Artificial Sequence
  Synthetic
  misc_feature (20)..(21): 2'-O-methyl
cacgaacaagcaacugaacuu

SEQ ID NO: 2378 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucagaugauauaaauguggtt

SEQ ID NO: 2379 - RNA, 21 nt, Artificial Sequence
  Synthetic
  misc_feature (20)..(21): 2'-O-methyl
ccacauuuauaucaucugauu

SEQ ID NO: 2380 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauguuaaauucuuggcuatt

SEQ ID NO: 2381 - RNA, 21 nt, Artificial Sequence
  Synthetic
  misc_feature (20)..(21): 2'-O-methyl
uagccaagaauuuaacauuuu

SEQ ID NO: 2382 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggguucagaugauauaaatt

SEQ ID NO: 2383 - RNA, 21 nt, Artificial Sequence
  Synthetic
  misc_feature (20)..(21): 2'-O-methyl
uuuauaucaucugaacccauu

SEQ ID NO: 2384 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauaguugaagguuguacctt

SEQ ID NO: 2385 - RNA, 21 nt, Artificial Sequence
  Synthetic
  misc_feature (20)..(21): 2'-O-methyl
gguacaaccuucaacuauuuu

SEQ ID NO: 2386 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caugcaguuguaaacuugatt

SEQ ID NO: 2387 - RNA, 21 nt, Artificial Sequence
  Synthetic
  misc_feature (20)..(21): 2'-O-methyl
ucaaguuuacaacugcauguu

SEQ ID NO: 2388 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaucugaauaaaguguaactt

SEQ ID NO: 2389 - RNA, 21 nt, Artificial Sequence
  Synthetic
  misc_feature (20)..(21): 2'-O-methyl
guuacacuuuauucagauuuu

SEQ ID NO: 2390 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caccacccuggugcugacutt

SEQ ID NO: 2391 - RNA, 21 nt, Artificial Sequence
  Synthetic
  misc_feature (20)..(21): 2'-O-methyl
agucagcaccagggugguguu

SEQ ID NO: 2392 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaguuggacauggccauggtt

SEQ ID NO: 2393 - RNA, 21 nt, Artificial Sequence
  Synthetic
  misc_feature (20)..(21): 2'-O-methyl
ccauggccauguccaacucuu

SEQ ID NO: 2394 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auacccagcgccguacguctt

SEQ ID NO: 2395 - RNA, 21 nt, Artificial Sequence
  Synthetic
  misc_feature (20)..(21): 2'-O-methyl
gacguacggcgcuggguauuu

SEQ ID NO: 2396 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagggcuuacuggccaucutt

SEQ ID NO: 2397 - RNA, 21 nt, Artificial Sequence
  Synthetic
  misc_feature (20)..(21): 2'-O-methyl
agauggccaguaagcccucuu

SEQ ID NO: 2398 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagggcaugcagaucccautt

SEQ ID NO: 2399 - RNA, 21 nt, Artificial Sequence
  Synthetic
  misc_feature (20)..(21): 2'-O-methyl
augggaucugcaugcccucuu

SEQ ID NO: 2400 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagggauggaaggucucctt

SEQ ID NO: 2401 - RNA, 21 nt, Artificial Sequence
  Synthetic
  misc_feature (20)..(21): 2'-O-methyl
ggagaccuuccaucccuucuu

SEQ ID NO: 2402 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucugaggacaagccacaatt

SEQ ID NO: 2403 - RNA, 21 nt, Artificial Sequence
  Synthetic
  misc_feature (20)..(21): 2'-O-methyl
uuguggcuuguccucagacuu

SEQ ID NO: 2404 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaugcaccuuugcgugagtt

SEQ ID NO: 2405 - RNA, 21 nt, Artificial Sequence
  Synthetic
  misc_feature (20)..(21): 2'-O-methyl
cucacgcaaaggugcaugauu

SEQ ID NO: 2406 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaaucuuucagaugcugctt

SEQ ID NO: 2407 - RNA, 21 nt, Artificial Sequence
  Synthetic
  misc_feature (20)..(21): 2'-O-methyl
gcagcaucugaaagauuccuu

SEQ ID NO: 2408 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaccugacagauccaagutt

SEQ ID NO: 2409 - RNA, 21 nt, Artificial Sequence
  Synthetic
  misc_feature (20)..(21): 2'-O-methyl
acuuggaucugucaggugauu

SEQ ID NO: 2410 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugaaggugcuaucugucutt

SEQ ID NO: 2411 - RNA, 21 nt, Artificial Sequence
  Synthetic
  misc_feature (20)..(21): 2'-O-methyl
agacagauagcaccuucaguu

SEQ ID NO: 2412 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucaucugaccagccgacatt

SEQ ID NO: 2413 - RNA, 21 nt, Artificial Sequence
  Synthetic
  misc_feature (20)..(21): 2'-O-methyl
ugucggcuggucagaugacuu

SEQ ID NO: 2414 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauuccacgacuaguucagtt

SEQ ID NO: 2415 - RNA, 21 nt, Artificial Sequence
  Synthetic
  misc_feature (20)..(21): 2'-O-methyl
cugaacuagucguggaauguu

SEQ ID NO: 2416 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauccuagcuaucguucutt

SEQ ID NO: 2417 - RNA, 21 nt, Artificial Sequence
  Synthetic
  misc_feature (20)..(21): 2'-O-methyl
agaacgauagcuaggaucauu

SEQ ID NO: 2418 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagcccuucacauccuagctt

SEQ ID NO: 2419 - RNA, 21 nt, Artificial Sequence
  Synthetic
  misc_feature (20)..(21): 2'-O-methyl
gcuaggaugugaagggcucuu

SEQ ID NO: 2420 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugaacuugcucaggacaatt

SEQ ID NO: 2421 - RNA, 21 nt, Artificial Sequence
  Synthetic
  misc_feature (20)..(21): 2'-O-methyl
uuguccugagcaaguucacuu

SEQ ID NO: 2422 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugagggcaugcagaucctt

SEQ ID NO: 2423 - RNA, 21 nt, Artificial Sequence
  Synthetic
  misc_feature (20)..(21): 2'-O-methyl
ggaucugcaugcccucaucuu

SEQ ID NO: 2424 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggguaggguaaaucagutt

SEQ ID NO: 2425 - RNA, 21 nt, Artificial Sequence
  Synthetic
  misc_feature (20)..(21): 2'-O-methyl
acugauuuacccuacccauuu

SEQ ID NO: 2426 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcaaucccugaacugactt

SEQ ID NO: 2427 - RNA, 21 nt, Artificial Sequence
  Synthetic
  misc_feature (20)..(21): 2'-O-methyl
gucaguucagggauugcacuu

SEQ ID NO: 2428 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuccauuguuugugcagctt

SEQ ID NO: 2429 - RNA, 21 nt, Artificial Sequence
  Synthetic
  misc_feature (20)..(21): 2'-O-methyl
gcugcacaaacaauggaauuu

SEQ ID NO: 2430 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuuaguaaauauaaugaggtt

SEQ ID NO: 2431 - RNA, 21 nt, Artificial Sequence
  Synthetic
  misc_feature (20)..(21): 2'-O-methyl
ccucauuauauuuacuaaauu

SEQ ID NO: 2432 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauucuggugccacuaccatt

SEQ ID NO: 2433 - RNA, 21 nt, Artificial Sequence
  Synthetic
  misc_feature (20)..(21): 2'-O-methyl
ugguaguggcaccagaauguu

SEQ ID NO: 2434 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaccaugcagaauacaaautt

SEQ ID NO: 2435 - RNA, 21 nt, Artificial Sequence
  Synthetic
  misc_feature (20)..(21): 2'-O-methyl
auuuguauucugcaugguauu

SEQ ID NO: 2436 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuaauguccagcguuuggtt

SEQ ID NO: 2437 - RNA, 21 nt, Artificial Sequence
  Synthetic
  misc_feature (20)..(21): 2'-O-methyl
ccaaacgcuggacauuaguuu

SEQ ID NO: 2438 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcaguucgccuucacuatt

SEQ ID NO: 2439 - RNA, 21 nt, Artificial Sequence
  Synthetic
  misc_feature (20)..(21): 2'-O-methyl
uagugaaggcgaacugcauuu

SEQ ID NO: 2440 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuacuggccaucuuuaagutt

SEQ ID NO: 2441 - RNA, 21 nt, Artificial Sequence
  Synthetic
  misc_feature (20)..(21): 2'-O-methyl
acuuaaagauggccaguaauu

SEQ ID NO: 2442 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuucuggguucagaugautt

SEQ ID NO: 2443 - RNA, 21 nt, Artificial Sequence
  Synthetic
  misc_feature (20)..(21): 2'-O-methyl
aucaucugaacccagaagcuu

SEQ ID NO: 2444 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caggaagggauggaagguctt

SEQ ID NO: 2445 - RNA, 21 nt, Artificial Sequence
  Synthetic
  misc_feature (20)..(21): 2'-O-methyl
gaccuuccaucccuuccuguu

SEQ ID NO: 2446 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggauaccucccaaguccutt

SEQ ID NO: 2447 - RNA, 21 nt, Artificial Sequence
  Synthetic
  misc_feature (20)..(21): 2'-O-methyl
aggacuugggagguauccauu

SEQ ID NO: 2448 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuuauggcaaccaagaaatt

SEQ ID NO: 2449 - RNA, 21 nt, Artificial Sequence
  Synthetic
  misc_feature (20)..(21): 2'-O-methyl
uuucuugguugccauaagcuu

SEQ ID NO: 2450 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugacagggaagacaucacutt

SEQ ID NO: 2451 - RNA, 21 nt, Artificial Sequence
  Synthetic
  misc_feature (20)..(21): 2'-O-methyl
agugaugucuucccugucauu

SEQ ID NO: 2452 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucgccaggaugauccuagtt

SEQ ID NO: 2453 - RNA, 21 nt, Artificial Sequence
  Synthetic
  misc_feature (20)..(21): 2'-O-methyl
cuaggaucauccuggcgauuu

SEQ ID NO: 2454 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguaauaagccggcuauugtt

SEQ ID NO: 2455 - RNA, 21 nt, Artificial Sequence
  Synthetic
  misc_feature (20)..(21): 2'-O-methyl
caauagccggcuuauuacuuu

SEQ ID NO: 2456 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaugauguagaaacagcuctt

SEQ ID NO: 2457 - RNA, 21 nt, Artificial Sequence
  Synthetic
  misc_feature (20)..(21): 2'-O-methyl
gagcuguuucuacaucauuuu

SEQ ID NO: 2458 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugaggacaagccacaagtt

SEQ ID NO: 2459 - RNA, 21 nt, Artificial Sequence
  Synthetic
  misc_feature (20)..(21): 2'-O-methyl
cuuguggcuuguccucagauu

SEQ ID NO: 2460 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggucuccuugggacucuugtt

SEQ ID NO: 2461 - RNA, 21 nt, Artificial Sequence
  Synthetic
  misc_feature (20)..(21): 2'-O-methyl
caagagucccaaggagaccuu

SEQ ID NO: 2462 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguucagaacugucuuuggtt

SEQ ID NO: 2463 - RNA, 21 nt, Artificial Sequence
  Synthetic
  misc_feature (20)..(21): 2'-O-methyl
ccaaagacaguucugaacauu

SEQ ID NO: 2464 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuggugccacuaccacagctt

SEQ ID NO: 2465 - RNA, 21 nt, Artificial Sequence
  Synthetic
  misc_feature (20)..(21): 2'-O-methyl
gcugugguaguggcaccaguu

SEQ ID NO: 2466 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guccaugggugggacacagtt

SEQ ID NO: 2467 - RNA, 21 nt, Artificial Sequence
  Synthetic
  misc_feature (20)..(21): 2'-O-methyl
cugugucccacccauggacuu

SEQ ID NO: 2468 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcguuuagcuggugggctt

SEQ ID NO: 2469 - RNA, 21 nt, Artificial Sequence
  Synthetic
  misc_feature (20)..(21): 2'-O-methyl
gcccaccagcuaaacgcacuu

SEQ ID NO: 2470 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acguaccaugcagaauacatt

SEQ ID NO: 2471 - RNA, 21 nt, Artificial Sequence
  Synthetic
  misc_feature (20)..(21): 2'-O-methyl
uguauucugcaugguacguuu

SEQ ID NO: 2472 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauguucacaaccgaauugtt

SEQ ID NO: 2473 - RNA, 21 nt, Artificial Sequence
  Synthetic
  misc_feature (20)..(21): 2'-O-methyl
caauucgguugugaacaucuu

SEQ ID NO: 2474 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaaagcaagcucaucauatt

SEQ ID NO: 2475 - RNA, 21 nt, Artificial Sequence
  Synthetic
  misc_feature (20)..(21): 2'-O-methyl
uaugaugagcuugcuuucuuu

SEQ ID NO: 2476 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucagcuucuggguucagtt

SEQ ID NO: 2477 - RNA, 21 nt, Artificial Sequence
  Synthetic
  misc_feature (20)..(21): 2'-O-methyl
cugaacccagaagcugaacuu

SEQ ID NO: 2478 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcagggugccauuccacgatt

SEQ ID NO: 2479 - RNA, 21 nt, Artificial Sequence
  Synthetic
  misc_feature (20)..(21): 2'-O-methyl
ucguggaauggcacccugcuu

SEQ ID NO: 2480 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagaagcugguggaaugcatt

SEQ ID NO: 2481 - RNA, 21 nt, Artificial Sequence
  Synthetic
  misc_feature (20)..(21): 2'-O-methyl
ugcauuccaccagcuucuauu

SEQ ID NO: 2482 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauggaagaaauaguugaatt

SEQ ID NO: 2483 - RNA, 21 nt, Artificial Sequence
  Synthetic
  misc_feature (20)..(21): 2'-O-methyl
uucaacuauuucuuccauguu

SEQ ID NO: 2484 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauauuggugcccagggatt

SEQ ID NO: 2485 - RNA, 21 nt, Artificial Sequence
  Synthetic
  misc_feature (20)..(21): 2'-O-methyl
ucccugggcaccaauaucauu

SEQ ID NO: 2486 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcaugcagaucccaucuatt

SEQ ID NO: 2487 - RNA, 21 nt, Artificial Sequence
  Synthetic
  misc_feature (20)..(21): 2'-O-methyl
uagaugggaucugcaugccuu

SEQ ID NO: 2488 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cguacuguccuucgggcugtt

SEQ ID NO: 2489 - RNA, 21 nt, Artificial Sequence
  Synthetic
  misc_feature (20)..(21): 2'-O-methyl
cagcccgaaggacaguacguu

SEQ ID NO: 2490 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuacgacagacugccuucatt

SEQ ID NO: 2491 - RNA, 21 nt, Artificial Sequence
  Synthetic
  misc_feature (20)..(21): 2'-O-methyl
ugaaggcagucugucguaauu

SEQ ID NO: 2492 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagucacuggcagcaacagtt

SEQ ID NO: 2493 - RNA, 21 nt, Artificial Sequence
  Synthetic
  misc_feature (20)..(21): 2'-O-methyl
cuguugcugccagugacuauu

SEQ ID NO: 2494 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccauuacaacucuccacatt

SEQ ID NO: 2495 - RNA, 21 nt, Artificial Sequence
  Synthetic
  misc_feature (20)..(21): 2'-O-methyl
uguggagaguuguaauggcuu

SEQ ID NO: 2496 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccuucacuauggacuacctt

SEQ ID NO: 2497 - RNA, 21 nt, Artificial Sequence
  Synthetic
  misc_feature (20)..(21): 2'-O-methyl
gguaguccauagugaaggcuu

SEQ ID NO: 2498 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucacaaccgaauuguuatt

SEQ ID NO: 2499 - RNA, 21 nt, Artificial Sequence
  Synthetic
  misc_feature (20)..(21): 2'-O-methyl
uaacaauucgguugugaacuu

SEQ ID NO: 2500 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggaccuugcauaaccuuutt

SEQ ID NO: 2501 - RNA, 21 nt, Artificial Sequence
  Synthetic
  misc_feature (20)..(21): 2'-O-methyl
aaagguuaugcaaggucccuu

SEQ ID NO: 2502 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagccacaagauuacaagatt

SEQ ID NO: 2503 - RNA, 21 nt, Artificial Sequence
  Synthetic
  misc_feature (20)..(21): 2'-O-methyl
ucuuguaaucuuguggcuuuu

SEQ ID NO: 2504 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcagcaacagucuuaccugtt

SEQ ID NO: 2505 - RNA, 21 nt, Artificial Sequence
  Synthetic
  misc_feature (20)..(21): 2'-O-methyl
cagguaagacuguugcugcuu

SEQ ID NO: 2506 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauuacaucaagaaggagctt

SEQ ID NO: 2507 - RNA, 21 nt, Artificial Sequence
  Synthetic
  misc_feature (20)..(21): 2'-O-methyl
gcuccuucuugauguaauauu

SEQ ID NO: 2508 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaauaaggcugcaguuaugtt

SEQ ID NO: 2509 - RNA, 21 nt, Artificial Sequence
  Synthetic
  misc_feature (20)..(21): 2'-O-methyl
cauaacugcagccuuauuauu

SEQ ID NO: 2510 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaacgucuuguucagaactt

SEQ ID NO: 2511 - RNA, 21 nt, Artificial Sequence
  Synthetic
  misc_feature (20)..(21): 2'-O-methyl
guucugaacaagacguugauu

SEQ ID NO: 2512 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccgcauggaagaaauagutt

SEQ ID NO: 2513 - RNA, 21 nt, Artificial Sequence
  Synthetic
  misc_feature (20)..(21): 2'-O-methyl
acuauuucuuccaugcggauu

SEQ ID NO: 2514 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguggugguuaauaaggcutt

SEQ ID NO: 2515 - RNA, 21 nt, Artificial Sequence
  Synthetic
  misc_feature (20)..(21): 2'-O-methyl
agccuuauuaaccaccaccuu

SEQ ID NO: 2516 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaauguccagcguuuggcutt

SEQ ID NO: 2517 - RNA, 21 nt, Artificial Sequence
  Synthetic
  misc_feature (20)..(21): 2'-O-methyl
agccaaacgcuggacauuauu

SEQ ID NO: 2518 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuucucugagugguaaaggtt

SEQ ID NO: 2519 - RNA, 21 nt, Artificial Sequence
  Synthetic
  misc_feature (20)..(21): 2'-O-methyl
ccuuuaccacucagagaaguu

SEQ ID NO: 2520 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accagccgacaccaagaagtt

SEQ ID NO: 2521 - RNA, 21 nt, Artificial Sequence
  Synthetic
  misc_feature (20)..(21): 2'-O-methyl
cuucuuggugucggcugguuu

SEQ ID NO: 2522 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaccucccaaguccuguatt

SEQ ID NO: 2523 - RNA, 21 nt, Artificial Sequence
  Synthetic
  misc_feature (20)..(21): 2'-O-methyl
uacaggacuugggagguauuu

SEQ ID NO: 2524 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucacuauggacuaccaguutt

SEQ ID NO: 2525 - RNA, 21 nt, Artificial Sequence
  Synthetic
  misc_feature (20)..(21): 2'-O-methyl
aacugguaguccauagugauu

SEQ ID NO: 2526 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggauacccagcgccguactt

SEQ ID NO: 2527 - RNA, 21 nt, Artificial Sequence
  Synthetic
  misc_feature (20)..(21): 2'-O-methyl
guacggcgcuggguauccuuu

SEQ ID NO: 2528 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agggaagacaucacugagctt

SEQ ID NO: 2529 - RNA, 21 nt, Artificial Sequence
  Synthetic
  misc_feature (20)..(21): 2'-O-methyl
gcucagugaugucuucccuuu

SEQ ID NO: 2530 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauaucgccaggaugaucctt

SEQ ID NO: 2531 - RNA, 21 nt, Artificial Sequence
  Synthetic
  misc_feature (20)..(21): 2'-O-methyl
ggaucauccuggcgauaucuu

SEQ ID NO: 2532 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaguagcugauauugauggtt

SEQ ID NO: 2533 - RNA, 21 nt, Artificial Sequence
  Synthetic
  misc_feature (20)..(21): 2'-O-methyl
ccaucaauaucagcuacuuuu

SEQ ID NO: 2534 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagcuuuaggacuucacctt

SEQ ID NO: 2535 - RNA, 21 nt, Artificial Sequence
  Synthetic
  misc_feature (20)..(21): 2'-O-methyl
ggugaaguccuaaagcuuguu

SEQ ID NO: 2536 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccuuugucccgcaaaucatt

SEQ ID NO: 2537 - RNA, 21 nt, Artificial Sequence
  Synthetic
  misc_feature (20)..(21): 2'-O-methyl
ugauuugcgggacaaaggguu

SEQ ID NO: 2538 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuagaugagggcaugcagatt

SEQ ID NO: 2539 - RNA, 21 nt, Artificial Sequence
  Synthetic
  misc_feature (20)..(21): 2'-O-methyl
ucugcaugcccucaucuaauu

SEQ ID NO: 2540 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaugacucgagcucagagtt

SEQ ID NO: 2541 - RNA, 21 nt, Artificial Sequence
  Synthetic
  misc_feature (20)..(21): 2'-O-methyl
cucugagcucgagucauuguu

SEQ ID NO: 2542 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guggauauggccaggaugctt

SEQ ID NO: 2543 - RNA, 21 nt, Artificial Sequence
  Synthetic
  misc_feature (20)..(21): 2'-O-methyl
gcauccuggccauauccacuu

SEQ ID NO: 2544 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucagaugauauaaaugutt

SEQ ID NO: 2545 - RNA, 21 nt, Artificial Sequence
  Synthetic
  misc_feature (20)..(21): 2'-O-methyl
acauuuauaucaucugaacuu

SEQ ID NO: 2546 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaggacaaggaagcugcatt

SEQ ID NO: 2547 - RNA, 21 nt, Artificial Sequence
  Synthetic
  misc_feature (20)..(21): 2'-O-methyl
ugcagcuuccuuguccugauu

SEQ ID NO: 2548 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugaagcugagggagccactt

SEQ ID NO: 2549 - RNA, 21 nt, Artificial Sequence
  Synthetic
  misc_feature (20)..(21): 2'-O-methyl
guggcucccucagcuucaauu

SEQ ID NO: 2550 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaguuggacauggccautt

SEQ ID NO: 2551 - RNA, 21 nt, Artificial Sequence
  Synthetic
  misc_feature (20)..(21): 2'-O-methyl
auggccauguccaacuccauu

SEQ ID NO: 2552 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaugcugaaacaugcagutt

SEQ ID NO: 2553 - RNA, 21 nt, Artificial Sequence
  Synthetic
  misc_feature (20)..(21): 2'-O-methyl
acugcauguuucagcaucuuu

SEQ ID NO: 2554 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauggucugccaagugggtt

SEQ ID NO: 2555 - RNA, 21 nt, Artificial Sequence
  Synthetic
  misc_feature (20)..(21): 2'-O-methyl
cccacuuggcagaccaucauu

SEQ ID NO: 2556 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaugcaguuguaaacuugtt

SEQ ID NO: 2557 - RNA, 21 nt, Artificial Sequence
  Synthetic
  misc_feature (20)..(21): 2'-O-methyl
caaguuuacaacugcauguuu

SEQ ID NO: 2558 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaguuacuucacucuagtt

SEQ ID NO: 2559 - RNA, 21 nt, Artificial Sequence
  Synthetic
  misc_feature (20)..(21): 2'-O-methyl
cuagagugaaguaacucuguu

SEQ ID NO: 2560 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacucgagcucagaggguatt

SEQ ID NO: 2561 - RNA, 21 nt, Artificial Sequence
  Synthetic
  misc_feature (20)..(21): 2'-O-methyl
uacccucugagcucgagucuu

SEQ ID NO: 2562 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuggccaucuuuaagucugtt

SEQ ID NO: 2563 - RNA, 21 nt, Artificial Sequence
  Synthetic
  misc_feature (20)..(21): 2'-O-methyl
cagacuuaaagauggccaguu

SEQ ID NO: 2564 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacgaugcuucaagagaaatt

SEQ ID NO: 2565 - RNA, 21 nt, Artificial Sequence
  Synthetic
  misc_feature (20)..(21): 2'-O-methyl
uuucucuugaagcaucguauu

SEQ ID NO: 2566 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaccagcucucucuucagtt

SEQ ID NO: 2567 - RNA, 21 nt, Artificial Sequence
  Synthetic
  misc_feature (20)..(21): 2'-O-methyl
cugaagagagagcuggucauu

SEQ ID NO: 2568 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucucuucagaacagagcctt

SEQ ID NO: 2569 - RNA, 21 nt, Artificial Sequence
  Synthetic
  misc_feature (20)..(21): 2'-O-methyl
ggcucuguucugaagagaguu

SEQ ID NO: 2570 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuuucaguugagcugacctt

SEQ ID NO: 2571 - RNA, 21 nt, Artificial Sequence
  Synthetic
  misc_feature (20)..(21): 2'-O-methyl
ggucagcucaacugaaagcuu

SEQ ID NO: 2572 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggugggacacagcagcaatt

SEQ ID NO: 2573 - RNA, 21 nt, Artificial Sequence
  Synthetic
  misc_feature (20)..(21): 2'-O-methyl
uugcugcugugucccacccuu

SEQ ID NO: 2574 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugccacacgugcaaucccutt

SEQ ID NO: 2575 - RNA, 21 nt, Artificial Sequence
  Synthetic
  misc_feature (20)..(21): 2'-O-methyl
agggauugcacguguggcauu

SEQ ID NO: 2576 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugugaacuugcucaggatt

SEQ ID NO: 2577 - RNA, 21 nt, Artificial Sequence
  Synthetic
  misc_feature (20)..(21): 2'-O-methyl
uccugagcaaguucacagauu

SEQ ID NO: 2578 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaguaaugguguagaacatt

SEQ ID NO: 2579 - RNA, 21 nt, Artificial Sequence
  Synthetic
  misc_feature (20)..(21): 2'-O-methyl
uguucuacaccauuacucauu

SEQ ID NO: 2580 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuggauugauucgaaauctt

SEQ ID NO: 2581 - RNA, 21 nt, Artificial Sequence
  Synthetic
  misc_feature (20)..(21): 2'-O-methyl
gauuucgaaucaauccaacuu

SEQ ID NO: 2582 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacaacucuccacaaccuutt

SEQ ID NO: 2583 - RNA, 21 nt, Artificial Sequence
  Synthetic
  misc_feature (20)..(21): 2'-O-methyl
aagguuguggagaguuguauu

SEQ ID NO: 2584 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaguccuguaugagugggtt

SEQ ID NO: 2585 - RNA, 21 nt, Artificial Sequence
  Synthetic
  misc_feature (20)..(21): 2'-O-methyl
cccacucauacaggacuuguu

SEQ ID NO: 2586 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaagggauggaaggucutt

SEQ ID NO: 2587 - RNA, 21 nt, Artificial Sequence
  Synthetic
  misc_feature (20)..(21): 2'-O-methyl
agaccuuccaucccuuccuuu

SEQ ID NO: 2588 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcucaucauacuggcuagtt

SEQ ID NO: 2589 - RNA, 21 nt, Artificial Sequence
  Synthetic
  misc_feature (20)..(21): 2'-O-methyl
cuagccaguaugaugagcuuu

SEQ ID NO: 2590 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaagcuuuaggacuucactt

SEQ ID NO: 2591 - RNA, 21 nt, Artificial Sequence
  Synthetic
  misc_feature (20)..(21): 2'-O-methyl
gugaaguccuaaagcuugcuu

SEQ ID NO: 2592 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auguggucaccugugcagctt

SEQ ID NO: 2593 - RNA, 21 nt, Artificial Sequence
  Synthetic
  misc_feature (20)..(21): 2'-O-methyl
gcugcacaggugaccacauuu

SEQ ID NO: 2594 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acucaagcugauuugauggtt

SEQ ID NO: 2595 - RNA, 21 nt, Artificial Sequence
  Synthetic
  misc_feature (20)..(21): 2'-O-methyl
ccaucaaaucagcuugaguuu

SEQ ID NO: 2596 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacauggccauggaaccagtt

SEQ ID NO: 2597 - RNA, 21 nt, Artificial Sequence
  Synthetic
  misc_feature (20)..(21): 2'-O-methyl
cugguuccauggccaugucuu

SEQ ID NO: 2598 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaaauauaaugaggaccutt

SEQ ID NO: 2599 - RNA, 21 nt, Artificial Sequence
  Synthetic
  misc_feature (20)..(21): 2'-O-methyl
agguccucauuauauuuacuu

SEQ ID NO: 2600 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgcauggaagaaauaguugtt

SEQ ID NO: 2601 - RNA, 21 nt, Artificial Sequence
  Synthetic
  misc_feature (20)..(21): 2'-O-methyl
caacuauuucuuccaugcguu

SEQ ID NO: 2602 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugcugcaacuaaacaggtt

SEQ ID NO: 2603 - RNA, 21 nt, Artificial Sequence
  Synthetic
  misc_feature (20)..(21): 2'-O-methyl
ccuguuuaguugcagcaucuu

SEQ ID NO: 2604 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauggaacaugagaugggtt

SEQ ID NO: 2605 - RNA, 21 nt, Artificial Sequence
  Synthetic
  misc_feature (20)..(21): 2'-O-methyl
cccaucucauguuccaucauu

SEQ ID NO: 2606 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccagguggugguuaauaagtt

SEQ ID NO: 2607 - RNA, 21 nt, Artificial Sequence
  Synthetic
  misc_feature (20)..(21): 2'-O-methyl
cuuauuaaccaccaccugguu

SEQ ID NO: 2608 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugacuauccaguugaugtt

SEQ ID NO: 2609 - RNA, 21 nt, Artificial Sequence
  Synthetic
  misc_feature (20)..(21): 2'-O-methyl
caucaacuggauagucagcuu

SEQ ID NO: 2610 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaggacaagccacaagautt

SEQ ID NO: 2611 - RNA, 21 nt, Artificial Sequence
  Synthetic
  misc_feature (20)..(21): 2'-O-methyl
aucuuguggcuuguccucauu

SEQ ID NO: 2612 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuggccaucuuuaagucutt

SEQ ID NO: 2613 - RNA, 21 nt, Artificial Sequence
  Synthetic
  misc_feature (20)..(21): 2'-O-methyl
agacuuaaagauggccaguuu

SEQ ID NO: 2614 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacggcuuucaguugagcutt

SEQ ID NO: 2615 - RNA, 21 nt, Artificial Sequence
  Synthetic
  misc_feature (20)..(21): 2'-O-methyl
agcucaacugaaagccguuuu

SEQ ID NO: 2616 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acugagccugccaucugugtt

SEQ ID NO: 2617 - RNA, 21 nt, Artificial Sequence
  Synthetic
  misc_feature (20)..(21): 2'-O-methyl
cacagauggcaggcucaguuu

SEQ ID NO: 2618 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggauguucacaaccgaauutt

SEQ ID NO: 2619 - RNA, 21 nt, Artificial Sequence
  Synthetic
  misc_feature (20)..(21): 2'-O-methyl
aauucgguugugaacauccuu

SEQ ID NO: 2620 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuacuguuggauugauucgtt

SEQ ID NO: 2621 - RNA, 21 nt, Artificial Sequence
  Synthetic
  misc_feature (20)..(21): 2'-O-methyl
cgaaucaauccaacaguaguu

SEQ ID NO: 2622 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guugugguuaagcucuuactt

SEQ ID NO: 2623 - RNA, 21 nt, Artificial Sequence
  Synthetic
  misc_feature (20)..(21): 2'-O-methyl
guaagagcuuaaccacaacuu

SEQ ID NO: 2624 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auacuggcuagugguggactt

SEQ ID NO: 2625 - RNA, 21 nt, Artificial Sequence
  Synthetic
  misc_feature (20)..(21): 2'-O-methyl
guccaccacuagccaguauuu

SEQ ID NO: 2626 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaccucauggaugggcugctt

SEQ ID NO: 2627 - RNA, 21 nt, Artificial Sequence
  Synthetic
  misc_feature (20)..(21): 2'-O-methyl
gcagcccauccaugaggucuu

SEQ ID NO: 2628 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagcucgggauguucacaatt

SEQ ID NO: 2629 - RNA, 21 nt, Artificial Sequence
  Synthetic
  misc_feature (20)..(21): 2'-O-methyl
uugugaacaucccgagcuauu

SEQ ID NO: 2630 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaacaugagauggguggcctt

SEQ ID NO: 2631 - RNA, 21 nt, Artificial Sequence
  Synthetic
  misc_feature (20)..(21): 2'-O-methyl
ggccacccaucucauguucuu

SEQ ID NO: 2632 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaaugcaguucgccuuctt

SEQ ID NO: 2633 - RNA, 21 nt, Artificial Sequence
  Synthetic
  misc_feature (20)..(21): 2'-O-methyl
gaaggcgaacugcauucuguu

SEQ ID NO: 2634 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acguccaugggugggacactt

SEQ ID NO: 2635 - RNA, 21 nt, Artificial Sequence
  Synthetic
  misc_feature (20)..(21): 2'-O-methyl
gugucccacccauggacguuu

SEQ ID NO: 2636 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguucaccaguggauucutt

SEQ ID NO: 2637 - RNA, 21 nt, Artificial Sequence
  Synthetic
  misc_feature (20)..(21): 2'-O-methyl
agaauccacuggugaaccauu

SEQ ID NO: 2638 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaucgccaggaugauccutt

SEQ ID NO: 2639 - RNA, 21 nt, Artificial Sequence
  Synthetic
  misc_feature (20)..(21): 2'-O-methyl
aggaucauccuggcgauauuu

SEQ ID NO: 2640 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacaggaagggauggaaggtt

SEQ ID NO: 2641 - RNA, 21 nt, Artificial Sequence
  Synthetic
  misc_feature (20)..(21): 2'-O-methyl
ccuuccaucccuuccuguuuu

SEQ ID NO: 2642 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guugagcugaccagcucuctt

SEQ ID NO: 2643 - RNA, 21 nt, Artificial Sequence
  Synthetic
  misc_feature (20)..(21): 2'-O-methyl
gagagcuggucagcucaacuu

SEQ ID NO: 2644 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaauguuaaauucuuggcutt

SEQ ID NO: 2645 - RNA, 21 nt, Artificial Sequence
  Synthetic
  misc_feature (20)..(21): 2'-O-methyl
agccaagaauuuaacauuuuu

SEQ ID NO: 2646 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacacgcuaucaugcguuctt

SEQ ID NO: 2647 - RNA, 21 nt, Artificial Sequence
  Synthetic
  misc_feature (20)..(21): 2'-O-methyl
gaacgcaugauagcgugucuu

SEQ ID NO: 2648 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcuauuguagaagcuggutt

SEQ ID NO: 2649 - RNA, 21 nt, Artificial Sequence
  Synthetic
  misc_feature (20)..(21): 2'-O-methyl
accagcuucuacaauagccuu

SEQ ID NO: 2650 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguugugguuaagcucuutt

SEQ ID NO: 2651 - RNA, 21 nt, Artificial Sequence
  Synthetic
  misc_feature (20)..(21): 2'-O-methyl
aagagcuuaaccacaacuguu

SEQ ID NO: 2652 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuacacaguuugaugcugctt

SEQ ID NO: 2653 - RNA, 21 nt, Artificial Sequence
  Synthetic
  misc_feature (20)..(21): 2'-O-methyl
gcagcaucaaacuguguaguu

SEQ ID NO: 2654 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaggcauuccugcccugtt

SEQ ID NO: 2655 - RNA, 21 nt, Artificial Sequence
  Synthetic
  misc_feature (20)..(21): 2'-O-methyl
cagggcaggaaugccuccauu

SEQ ID NO: 2656 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacaguuuaccaguugcctt

SEQ ID NO: 2657 - RNA, 21 nt, Artificial Sequence
  Synthetic
  misc_feature (20)..(21): 2'-O-methyl
ggcaacugguaaacuguccuu

SEQ ID NO: 2658 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccauucuggugccacuactt

SEQ ID NO: 2659 - RNA, 21 nt, Artificial Sequence
  Synthetic
  misc_feature (20)..(21): 2'-O-methyl
guaguggcaccagaauggauu

SEQ ID NO: 2660 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacacccaccaucccacugtt

SEQ ID NO: 2661 - RNA, 21 nt, Artificial Sequence
  Synthetic
  misc_feature (20)..(21): 2'-O-methyl
cagugggaugguggguguauu

SEQ ID NO: 2662 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugagccugccaucugugctt

SEQ ID NO: 2663 - RNA, 21 nt, Artificial Sequence
  Synthetic
  misc_feature (20)..(21): 2'-O-methyl
gcacagauggcaggcucaguu

SEQ ID NO: 2664 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaggcauuccugcccuggutt

SEQ ID NO: 2665 - RNA, 21 nt, Artificial Sequence
  Synthetic
  misc_feature (20)..(21): 2'-O-methyl
accagggcaggaaugccucuu

SEQ ID NO: 2666 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuggcuauuacgacagactt

SEQ ID NO: 2667 - RNA, 21 nt, Artificial Sequence
  Synthetic
  misc_feature (20)..(21): 2'-O-methyl
gucugucguaauagccaaguu

SEQ ID NO: 2668 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccugagacauuagaugagtt

SEQ ID NO: 2669 - RNA, 21 nt, Artificial Sequence
  Synthetic
  misc_feature (20)..(21): 2'-O-methyl
cucaucuaaugucucaggguu

SEQ ID NO: 2670 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcaaugacucgagcucatt

SEQ ID NO: 2671 - RNA, 21 nt, Artificial Sequence
  Synthetic
  misc_feature (20)..(21): 2'-O-methyl
ugagcucgagucauugcauuu

SEQ ID NO: 2672 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagaggcucuugugcguactt

SEQ ID NO: 2673 - RNA, 21 nt, Artificial Sequence
  Synthetic
  misc_feature (20)..(21): 2'-O-methyl
guacgcacaagagccucuauu

SEQ ID NO: 2674 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucacucuaggaaugaaggtt

SEQ ID NO: 2675 - RNA, 21 nt, Artificial Sequence
  Synthetic
  misc_feature (20)..(21): 2'-O-methyl
ccuucauuccuagagugaauu

SEQ ID NO: 2676 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacaagccacaagauuacatt

SEQ ID NO: 2677 - RNA, 21 nt, Artificial Sequence
  Synthetic
  misc_feature (20)..(21): 2'-O-methyl
uguaaucuuguggcuugucuu

SEQ ID NO: 2678 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaacuugccacacgugctt

SEQ ID NO: 2679 - RNA, 21 nt, Artificial Sequence
  Synthetic
  misc_feature (20)..(21): 2'-O-methyl
gcacguguggcaaguucuguu

SEQ ID NO: 2680 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaccuugcauaaccuuucctt

SEQ ID NO: 2681 - RNA, 21 nt, Artificial Sequence
  Synthetic
  misc_feature (20)..(21): 2'-O-methyl
ggaaagguuaugcaaggucuu

SEQ ID NO: 2682 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacuaccacagcuccuucutt

SEQ ID NO: 2683 - RNA, 21 nt, Artificial Sequence
  Synthetic
  misc_feature (20)..(21): 2'-O-methyl
agaaggagcugugguaguguu

SEQ ID NO: 2684 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuauuugggauauguauggtt

SEQ ID NO: 2685 - RNA, 21 nt, Artificial Sequence
  Synthetic
  misc_feature (20)..(21): 2'-O-methyl
ccauacauaucccaaauaguu

SEQ ID NO: 2686 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuuguucagaacugucuutt

SEQ ID NO: 2687 - RNA, 21 nt, Artificial Sequence
  Synthetic
  misc_feature (20)..(21): 2'-O-methyl
aagacaguucugaacaagauu

SEQ ID NO: 2688 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugccuuggguauggacctt

SEQ ID NO: 2689 - RNA, 21 nt, Artificial Sequence
  Synthetic
  misc_feature (20)..(21): 2'-O-methyl
gguccauacccaaggcaucuu

SEQ ID NO: 2690 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguagaagcugguggaautt

SEQ ID NO: 2691 - RNA, 21 nt, Artificial Sequence
  Synthetic
  misc_feature (20)..(21): 2'-O-methyl
auuccaccagcuucuacaauu

SEQ ID NO: 2692 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agguguggcgacauaugcatt

SEQ ID NO: 2693 - RNA, 21 nt, Artificial Sequence
  Synthetic
  misc_feature (20)..(21): 2'-O-methyl
ugcauaugucgccacaccuuu

SEQ ID NO: 2694 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaaucccugaacugacaatt

SEQ ID NO: 2695 - RNA, 21 nt, Artificial Sequence
  Synthetic
  misc_feature (20)..(21): 2'-O-methyl
uugucaguucagggauugcuu

SEQ ID NO: 2696 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcucuaguaauaagccggtt

SEQ ID NO: 2697 - RNA, 21 nt, Artificial Sequence
  Synthetic
  misc_feature (20)..(21): 2'-O-methyl
ccggcuuauuacuagagcauu

SEQ ID NO: 2698 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccgacaccaagaagcagagtt

SEQ ID NO: 2699 - RNA, 21 nt, Artificial Sequence
  Synthetic
  misc_feature (20)..(21): 2'-O-methyl
cucugcuucuuggugucgguu

SEQ ID NO: 2700 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaugaugcagaacuugcctt

SEQ ID NO: 2701 - RNA, 21 nt, Artificial Sequence
  Synthetic
  misc_feature (20)..(21): 2'-O-methyl
ggcaaguucugcaucaucuuu

SEQ ID NO: 2702 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugaugggcugccagaucutt

SEQ ID NO: 2703 - RNA, 21 nt, Artificial Sequence
  Synthetic
  misc_feature (20)..(21): 2'-O-methyl
agaucuggcagcccaucaauu

SEQ ID NO: 2704 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agccgacaccaagaagcagtt

SEQ ID NO: 2705 - RNA, 21 nt, Artificial Sequence
  Synthetic
  misc_feature (20)..(21): 2'-O-methyl
cugcuucuuggugucggcuuu

SEQ ID NO: 2706 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauggguaggguaaaucagtt

SEQ ID NO: 2707 - RNA, 21 nt, Artificial Sequence
  Synthetic
  misc_feature (20)..(21): 2'-O-methyl
cugauuuacccuacccauauu

SEQ ID NO: 2708 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucaucauacuggcuagugtt

SEQ ID NO: 2709 - RNA, 21 nt, Artificial Sequence
  Synthetic
  misc_feature (20)..(21): 2'-O-methyl
cacuagccaguaugaugaguu

SEQ ID NO: 2710 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauuacgacagacugccuutt

SEQ ID NO: 2711 - RNA, 21 nt, Artificial Sequence
  Synthetic
  misc_feature (20)..(21): 2'-O-methyl
aaggcagucugucguaauauu

SEQ ID NO: 2712 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaucccugaacugacaaatt

SEQ ID NO: 2713 - RNA, 21 nt, Artificial Sequence
  Synthetic
  misc_feature (20)..(21): 2'-O-methyl
uuugucaguucagggauuguu

SEQ ID NO: 2714 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuccuugggacucuuguutt

SEQ ID NO: 2715 - RNA, 21 nt, Artificial Sequence
  Synthetic
  misc_feature (20)..(21): 2'-O-methyl
aacaagagucccaaggagauu

SEQ ID NO: 2716 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagauggguggccaccacctt

SEQ ID NO: 2717 - RNA, 21 nt, Artificial Sequence
  Synthetic
  misc_feature (20)..(21): 2'-O-methyl
ggugguggccacccaucucuu

SEQ ID NO: 2718 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagggugccauuccacgactt

SEQ ID NO: 2719 - RNA, 21 nt, Artificial Sequence
  Synthetic
  misc_feature (20)..(21): 2'-O-methyl
gucguggaauggcacccuguu

SEQ ID NO: 2720 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguuacuucacucuaggaatt

SEQ ID NO: 2721 - RNA, 21 nt, Artificial Sequence
  Synthetic
  misc_feature (20)..(21): 2'-O-methyl
uuccuagagugaaguaacuuu

SEQ ID NO: 2722 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuggacuugauauuggugctt

SEQ ID NO: 2723 - RNA, 21 nt, Artificial Sequence
  Synthetic
  misc_feature (20)..(21): 2'-O-methyl
gcaccaauaucaaguccaauu

SEQ ID NO: 2724 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccuucacauccuagcucgtt

SEQ ID NO: 2725 - RNA, 21 nt, Artificial Sequence
  Synthetic
  misc_feature (20)..(21): 2'-O-methyl
cgagcuaggaugugaaggguu

SEQ ID NO: 2726 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agacacgcuaucaugcguutt

SEQ ID NO: 2727 - RNA, 21 nt, Artificial Sequence
  Synthetic
  misc_feature (20)..(21): 2'-O-methyl
aacgcaugauagcgugucuuu

SEQ ID NO: 2728 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaugcaguucgccuucacutt

SEQ ID NO: 2729 - RNA, 21 nt, Artificial Sequence
  Synthetic
  misc_feature (20)..(21): 2'-O-methyl
agugaaggcgaacugcauuuu

SEQ ID NO: 2730 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuauggcaaccaagaaagtt

SEQ ID NO: 2731 - RNA, 21 nt, Artificial Sequence
  Synthetic
  misc_feature (20)..(21): 2'-O-methyl
cuuucuugguugccauaaguu

SEQ ID NO: 2732 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucccaaguccuguaugagtt

SEQ ID NO: 2733 - RNA, 21 nt, Artificial Sequence
  Synthetic
  misc_feature (20)..(21): 2'-O-methyl
cucauacaggacuugggaguu

SEQ ID NO: 2734 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuacacccaccaucccactt

SEQ ID NO: 2735 - RNA, 21 nt, Artificial Sequence
  Synthetic
  misc_feature (20)..(21): 2'-O-methyl
gugggaugguggguguaaguu

SEQ ID NO: 2736 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaaggucuccuugggactt

SEQ ID NO: 2737 - RNA, 21 nt, Artificial Sequence
  Synthetic
  misc_feature (20)..(21): 2'-O-methyl
gucccaaggagaccuuccauu

SEQ ID NO: 2738 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcccuucacauccuagcutt

SEQ ID NO: 2739 - RNA, 21 nt, Artificial Sequence
  Synthetic
  misc_feature (20)..(21): 2'-O-methyl
agcuaggaugugaagggcuuu

SEQ ID NO: 2740 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugggcugccuccaggugtt

SEQ ID NO: 2741 - RNA, 21 nt, Artificial Sequence
  Synthetic
  misc_feature (20)..(21): 2'-O-methyl
caccuggaggcagcccaucuu

SEQ ID NO: 2742 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcuucuggguucagaugatt

SEQ ID NO: 2743 - RNA, 21 nt, Artificial Sequence
  Synthetic
  misc_feature (20)..(21): 2'-O-methyl
ucaucugaacccagaagcuuu

SEQ ID NO: 2744 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagccugccaucugugcuctt

SEQ ID NO: 2745 - RNA, 21 nt, Artificial Sequence
  Synthetic
  misc_feature (20)..(21): 2'-O-methyl
gagcacagauggcaggcucuu

SEQ ID NO: 2746 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuaagucuggaggcauucctt

SEQ ID NO: 2747 - RNA, 21 nt, Artificial Sequence
  Synthetic
  misc_feature (20)..(21): 2'-O-methyl
ggaaugccuccagacuuaauu

SEQ ID NO: 2748 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accugugcagcuggaauuctt

SEQ ID NO: 2749 - RNA, 21 nt, Artificial Sequence
  Synthetic
  misc_feature (20)..(21): 2'-O-methyl
gaauuccagcugcacagguuu

SEQ ID NO: 2750 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucccgcaaaucaugcaccutt

SEQ ID NO: 2751 - RNA, 21 nt, Artificial Sequence
  Synthetic
  misc_feature (20)..(21): 2'-O-methyl
aggugcaugauuugcgggauu

SEQ ID NO: 2752 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagguguggcgacauaugctt

SEQ ID NO: 2753 - RNA, 21 nt, Artificial Sequence
  Synthetic
  misc_feature (20)..(21): 2'-O-methyl
gcauaugucgccacaccuuuu

SEQ ID NO: 2754 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcuauugaagcugagggatt

SEQ ID NO: 2755 - RNA, 21 nt, Artificial Sequence
  Synthetic
  misc_feature (20)..(21): 2'-O-methyl
ucccucagcuucaauagcuuu

SEQ ID NO: 2756 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuagucacuggcagcaactt

SEQ ID NO: 2757 - RNA, 21 nt, Artificial Sequence
  Synthetic
  misc_feature (20)..(21): 2'-O-methyl
guugcugccagugacuaacuu

SEQ ID NO: 2758 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaggaccucauggaugggtt

SEQ ID NO: 2759 - RNA, 21 nt, Artificial Sequence
  Synthetic
  misc_feature (20)..(21): 2'-O-methyl
cccauccaugagguccugguu

SEQ ID NO: 2760 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucaguugcuuguucgugctt

SEQ ID NO: 2761 - RNA, 21 nt, Artificial Sequence
  Synthetic
  misc_feature (20)..(21): 2'-O-methyl
gcacgaacaagcaacugaauu

SEQ ID NO: 2762 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaaggcuacuguuggauugtt

SEQ ID NO: 2763 - RNA, 21 nt, Artificial Sequence
  Synthetic
  misc_feature (20)..(21): 2'-O-methyl
caauccaacaguagccuuuuu

SEQ ID NO: 2764 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaccucauggaugggcutt

SEQ ID NO: 2765 - RNA, 21 nt, Artificial Sequence
  Synthetic
  misc_feature (20)..(21): 2'-O-methyl
agcccauccaugagguccuuu

SEQ ID NO: 2766 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugauggucugccaagugtt

SEQ ID NO: 2767 - RNA, 21 nt, Artificial Sequence
  Synthetic
  misc_feature (20)..(21): 2'-O-methyl
cacuuggcagaccaucaucuu

SEQ ID NO: 2768 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaaacaggaagggauggatt

SEQ ID NO: 2769 - RNA, 21 nt, Artificial Sequence
  Synthetic
  misc_feature (20)..(21): 2'-O-methyl
uccaucccuuccuguuuaguu

SEQ ID NO: 2770 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccacgacuaguucaguugctt

SEQ ID NO: 2771 - RNA, 21 nt, Artificial Sequence
  Synthetic
  misc_feature (20)..(21): 2'-O-methyl
gcaacugaacuagucgugguu

SEQ ID NO: 2772 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuaguucaguugcuuguutt

SEQ ID NO: 2773 - RNA, 21 nt, Artificial Sequence
  Synthetic
  misc_feature (20)..(21): 2'-O-methyl
aacaagcaacugaacuaguuu

SEQ ID NO: 2774 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucaccaguggauucugutt

SEQ ID NO: 2775 - RNA, 21 nt, Artificial Sequence
  Synthetic
  misc_feature (20)..(21): 2'-O-methyl
acagaauccacuggugaacuu

SEQ ID NO: 2776 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugguaaaggcaauccugatt

SEQ ID NO: 2777 - RNA, 21 nt, Artificial Sequence
  Synthetic
  misc_feature (20)..(21): 2'-O-methyl
ucaggauugccuuuaccacuu

SEQ ID NO: 2778 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugauggaguuggacauggtt

SEQ ID NO: 2779 - RNA, 21 nt, Artificial Sequence
  Synthetic
  misc_feature (20)..(21): 2'-O-methyl
ccauguccaacuccaucaauu

SEQ ID NO: 2780 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuggguucagaugauauatt

SEQ ID NO: 2781 - RNA, 21 nt, Artificial Sequence
  Synthetic
  misc_feature (20)..(21): 2'-O-methyl
uauaucaucugaacccagauu

SEQ ID NO: 2782 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggacaguaugcaaugacutt

SEQ ID NO: 2783 - RNA, 21 nt, Artificial Sequence
  Synthetic
  misc_feature (20)..(21): 2'-O-methyl
agucauugcauacuguccauu

SEQ ID NO: 2784 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccaaguccuguaugagugtt

SEQ ID NO: 2785 - RNA, 21 nt, Artificial Sequence
  Synthetic
  misc_feature (20)..(21): 2'-O-methyl
cacucauacaggacuuggguu

SEQ ID NO: 2786 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuugcucaggacaaggaatt

SEQ ID NO: 2787 - RNA, 21 nt, Artificial Sequence
  Synthetic
  misc_feature (20)..(21): 2'-O-methyl
uuccuuguccugagcaaguuu

SEQ ID NO: 2788 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaguugaugggcugccagtt

SEQ ID NO: 2789 - RNA, 21 nt, Artificial Sequence
  Synthetic
  misc_feature (20)..(21): 2'-O-methyl
cuggcagcccaucaacugguu

SEQ ID NO: 2790 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaagcaagcucaucauactt

SEQ ID NO: 2791 - RNA, 21 nt, Artificial Sequence
  Synthetic
  misc_feature (20)..(21): 2'-O-methyl
guaugaugagcuugcuuucuu

SEQ ID NO: 2792 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acauuagaugagggcaugctt

SEQ ID NO: 2793 - RNA, 21 nt, Artificial Sequence
  Synthetic
  misc_feature (20)..(21): 2'-O-methyl
gcaugcccucaucuaauguuu

SEQ ID NO: 2794 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucccacuaauguccagcgutt

SEQ ID NO: 2795 - RNA, 21 nt, Artificial Sequence
  Synthetic
  misc_feature (20)..(21): 2'-O-methyl
acgcuggacauuagugggauu

SEQ ID NO: 2796 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcaaccaagaaagcaagctt

SEQ ID NO: 2797 - RNA, 21 nt, Artificial Sequence
  Synthetic
  misc_feature (20)..(21): 2'-O-methyl
gcuugcuuucuugguugccuu

SEQ ID NO: 2798 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaaagaguagcugcagggtt

SEQ ID NO: 2799 - RNA, 21 nt, Artificial Sequence
  Synthetic
  misc_feature (20)..(21): 2'-O-methyl
cccugcagcuacucuuugguu

SEQ ID NO: 2800 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaauaguugaagguuguactt

SEQ ID NO: 2801 - RNA, 21 nt, Artificial Sequence
  Synthetic
  misc_feature (20)..(21): 2'-O-methyl
guacaaccuucaacuauuuuu

SEQ ID NO: 2802 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggauauguauggguagggutt

SEQ ID NO: 2803 - RNA, 21 nt, Artificial Sequence
  Synthetic
  misc_feature (20)..(21): 2'-O-methyl
acccuacccauacauauccuu

SEQ ID NO: 2804 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaucugaauaaaguguaatt

SEQ ID NO: 2805 - RNA, 21 nt, Artificial Sequence
  Synthetic
  misc_feature (20)..(21): 2'-O-methyl
uuacacuuuauucagauuauu

SEQ ID NO: 2806 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcacaucaggauacccagtt

SEQ ID NO: 2807 - RNA, 21 nt, Artificial Sequence
  Synthetic
  misc_feature (20)..(21): 2'-O-methyl
cuggguauccugaugugcauu

SEQ ID NO: 2808 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaauaagccggcuauugutt

SEQ ID NO: 2809 - RNA, 21 nt, Artificial Sequence
  Synthetic
  misc_feature (20)..(21): 2'-O-methyl
acaauagccggcuuauuacuu

SEQ ID NO: 2810 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcucaucauacuggcuatt

SEQ ID NO: 2811 - RNA, 21 nt, Artificial Sequence
  Synthetic
  misc_feature (20)..(21): 2'-O-methyl
uagccaguaugaugagcuuuu

SEQ ID NO: 2812 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acgugcaaucccugaacugtt

SEQ ID NO: 2813 - RNA, 21 nt, Artificial Sequence
  Synthetic
  misc_feature (20)..(21): 2'-O-methyl
caguucagggauugcacguuu

SEQ ID NO: 2814 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccaaagaguagcugcaggtt

SEQ ID NO: 2815 - RNA, 21 nt, Artificial Sequence
  Synthetic
  misc_feature (20)..(21): 2'-O-methyl
ccugcagcuacucuuuggauu

SEQ ID NO: 2816 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguugugguuaagcucuuatt

SEQ ID NO: 2817 - RNA, 21 nt, Artificial Sequence
  Synthetic
  misc_feature (20)..(21): 2'-O-methyl
uaagagcuuaaccacaacuuu

SEQ ID NO: 2818 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaccagguggugguuaatt

SEQ ID NO: 2819 - RNA, 21 nt, Artificial Sequence
  Synthetic
  misc_feature (20)..(21): 2'-O-methyl
uuaaccaccaccugguccuuu

SEQ ID NO: 2820 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucuaguaauaagccggctt

SEQ ID NO: 2821 - RNA, 21 nt, Artificial Sequence
  Synthetic
  misc_feature (20)..(21): 2'-O-methyl
gccggcuuauuacuagagcuu

SEQ ID NO: 2822 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauuugauggaguuggacatt

SEQ ID NO: 2823 - RNA, 21 nt, Artificial Sequence
  Synthetic
  misc_feature (20)..(21): 2'-O-methyl
uguccaacuccaucaaaucuu

SEQ ID NO: 2824 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauguagaaacagcucgutt

SEQ ID NO: 2825 - RNA, 21 nt, Artificial Sequence
  Synthetic
  misc_feature (20)..(21): 2'-O-methyl
acgagcuguuucuacaucauu

SEQ ID NO: 2826 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugguggauauggccaggatt

SEQ ID NO: 2827 - RNA, 21 nt, Artificial Sequence
  Synthetic
  misc_feature (20)..(21): 2'-O-methyl
uccuggccauauccaccaguu

SEQ ID NO: 2828 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caucauacuggcuaguggutt

SEQ ID NO: 2829 - RNA, 21 nt, Artificial Sequence
  Synthetic
  misc_feature (20)..(21): 2'-O-methyl
accacuagccaguaugauguu

SEQ ID NO: 2830 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaucccaucuacacaguuutt

SEQ ID NO: 2831 - RNA, 21 nt, Artificial Sequence
  Synthetic
  misc_feature (20)..(21): 2'-O-methyl
aaacuguguagaugggaucuu

SEQ ID NO: 2832 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacgcuaucaugcguucuctt

SEQ ID NO: 2833 - RNA, 21 nt, Artificial Sequence
  Synthetic
  misc_feature (20)..(21): 2'-O-methyl
gagaacgcaugauagcguguu

SEQ ID NO: 2834 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacaguaugcaaugacucgtt

SEQ ID NO: 2835 - RNA, 21 nt, Artificial Sequence
  Synthetic
  misc_feature (20)..(21): 2'-O-methyl
cgagucauugcauacugucuu

SEQ ID NO: 2836 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaguuguuguaaccugcugtt

SEQ ID NO: 2837 - RNA, 21 nt, Artificial Sequence
  Synthetic
  misc_feature (20)..(21): 2'-O-methyl
cagcagguuacaacaacuuuu

SEQ ID NO: 2838 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuauuacgacagacugcctt

SEQ ID NO: 2839 - RNA, 21 nt, Artificial Sequence
  Synthetic
  misc_feature (20)..(21): 2'-O-methyl
ggcagucugucguaauagcuu

SEQ ID NO: 2840 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccuccaggugacagcaautt

SEQ ID NO: 2841 - RNA, 21 nt, Artificial Sequence
  Synthetic
  misc_feature (20)..(21): 2'-O-methyl
auugcugucaccuggaggcuu

SEQ ID NO: 2842 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccuguaugagugggaacatt

SEQ ID NO: 2843 - RNA, 21 nt, Artificial Sequence
  Synthetic
  misc_feature (20)..(21): 2'-O-methyl
uguucccacucauacaggauu

SEQ ID NO: 2844 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcagaucccaucuacactt

SEQ ID NO: 2845 - RNA, 21 nt, Artificial Sequence
  Synthetic
  misc_feature (20)..(21): 2'-O-methyl
guguagaugggaucugcauuu

SEQ ID NO: 2846 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuucccaucaucgugagggtt

SEQ ID NO: 2847 - RNA, 21 nt, Artificial Sequence
  Synthetic
  misc_feature (20)..(21): 2'-O-methyl
cccucacgaugaugggaaauu

SEQ ID NO: 2848 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaagugggugguauagagtt

SEQ ID NO: 2849 - RNA, 21 nt, Artificial Sequence
  Synthetic
  misc_feature (20)..(21): 2'-O-methyl
cucuauaccacccacuugguu

SEQ ID NO: 2850 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaccuugcauaaccuuuctt

SEQ ID NO: 2851 - RNA, 21 nt, Artificial Sequence
  Synthetic
  misc_feature (20)..(21): 2'-O-methyl
gaaagguuaugcaagguccuu

SEQ ID NO: 2852 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucccaaguccuguaugagutt

SEQ ID NO: 2853 - RNA, 21 nt, Artificial Sequence
  Synthetic
  misc_feature (20)..(21): 2'-O-methyl
acucauacaggacuugggauu

SEQ ID NO: 2854 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacgacuaguucaguugcutt

SEQ ID NO: 2855 - RNA, 21 nt, Artificial Sequence
  Synthetic
  misc_feature (20)..(21): 2'-O-methyl
agcaacugaacuagucguguu

SEQ ID NO: 2856 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccgcauggaagaaauaguutt

SEQ ID NO: 2857 - RNA, 21 nt, Artificial Sequence
  Synthetic
  misc_feature (20)..(21): 2'-O-methyl
aacuauuucuuccaugcgguu

SEQ ID NO: 2858 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcccagaaugcaguucgctt

SEQ ID NO: 2859 - RNA, 21 nt, Artificial Sequence
  Synthetic
  misc_feature (20)..(21): 2'-O-methyl
gcgaacugcauucugggccuu

SEQ ID NO: 2860 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccauggaaccagacagaaatt

SEQ ID NO: 2861 - RNA, 21 nt, Artificial Sequence
  Synthetic
  misc_feature (20)..(21): 2'-O-methyl
uuucugucugguuccaugguu

SEQ ID NO: 2862 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaacggcuuucaguugagtt

SEQ ID NO: 2863 - RNA, 21 nt, Artificial Sequence
  Synthetic
  misc_feature (20)..(21): 2'-O-methyl
cucaacugaaagccguuucuu

SEQ ID NO: 2864 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggauauguauggguagggtt

SEQ ID NO: 2865 - RNA, 21 nt, Artificial Sequence
  Synthetic
  misc_feature (20)..(21): 2'-O-methyl
cccuacccauacauaucccuu

SEQ ID NO: 2866 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugggacucuuguucagcutt

SEQ ID NO: 2867 - RNA, 21 nt, Artificial Sequence
  Synthetic
  misc_feature (20)..(21): 2'-O-methyl
agcugaacaagagucccaauu

SEQ ID NO: 2868 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauguucccugagacauuatt

SEQ ID NO: 2869 - RNA, 21 nt, Artificial Sequence
  Synthetic
  misc_feature (20)..(21): 2'-O-methyl
uaaugucucagggaacauauu

SEQ ID NO: 2870 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacucucaggaaucuuuctt

SEQ ID NO: 2871 - RNA, 21 nt, Artificial Sequence
  Synthetic
  misc_feature (20)..(21): 2'-O-methyl
gaaagauuccugagaguccuu

SEQ ID NO: 2872 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcugcagaagcuauugatt

SEQ ID NO: 2873 - RNA, 21 nt, Artificial Sequence
  Synthetic
  misc_feature (20)..(21): 2'-O-methyl
ucaauagcuucugcagcuuuu

SEQ ID NO: 2874 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcccuucacauccuagcuctt

SEQ ID NO: 2875 - RNA, 21 nt, Artificial Sequence
  Synthetic
  misc_feature (20)..(21): 2'-O-methyl
gagcuaggaugugaagggcuu

SEQ ID NO: 2876 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcguacuguccuucgggctt

SEQ ID NO: 2877 - RNA, 21 nt, Artificial Sequence
  Synthetic
  misc_feature (20)..(21): 2'-O-methyl
gcccgaaggacaguacgcauu

SEQ ID NO: 2878 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agagauggcccagaaugcatt

SEQ ID NO: 2879 - RNA, 21 nt, Artificial Sequence
  Synthetic
  misc_feature (20)..(21): 2'-O-methyl
ugcauucugggccaucucuuu

SEQ ID NO: 2880 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaauccugaggaagaggatt

SEQ ID NO: 2881 - RNA, 21 nt, Artificial Sequence
  Synthetic
  misc_feature (20)..(21): 2'-O-methyl
uccucuuccucaggauugcuu

SEQ ID NO: 2882 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caggaugccuuggguauggtt

SEQ ID NO: 2883 - RNA, 21 nt, Artificial Sequence
  Synthetic
  misc_feature (20)..(21): 2'-O-methyl
ccauacccaaggcauccuguu

SEQ ID NO: 2884 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcuauguucccugagactt

SEQ ID NO: 2885 - RNA, 21 nt, Artificial Sequence
  Synthetic
  misc_feature (20)..(21): 2'-O-methyl
gucucagggaacauagcaguu

SEQ ID NO: 2886 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucacaaccgaauuguuautt

SEQ ID NO: 2887 - RNA, 21 nt, Artificial Sequence
  Synthetic
  misc_feature (20)..(21): 2'-O-methyl
auaacaauucgguugugaauu

SEQ ID NO: 2888 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaagcaagcucaucauacutt

SEQ ID NO: 2889 - RNA, 21 nt, Artificial Sequence
  Synthetic
  misc_feature (20)..(21): 2'-O-methyl
aguaugaugagcuugcuuuuu

SEQ ID NO: 2890 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggcaauccugaggaagagtt

SEQ ID NO: 2891 - RNA, 21 nt, Artificial Sequence
  Synthetic
  misc_feature (20)..(21): 2'-O-methyl
cucuuccucaggauugccuuu

SEQ ID NO: 2892 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguuugugcagcugcuuuatt

SEQ ID NO: 2893 - RNA, 21 nt, Artificial Sequence
  Synthetic
  misc_feature (20)..(21): 2'-O-methyl
uaaagcagcugcacaaacauu

SEQ ID NO: 2894 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaaugcaagcuuuaggactt

SEQ ID NO: 2895 - RNA, 21 nt, Artificial Sequence
  Synthetic
  misc_feature (20)..(21): 2'-O-methyl
guccuaaagcuugcauuccuu

SEQ ID NO: 2896 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugauauaaauguggucatt

SEQ ID NO: 2897 - RNA, 21 nt, Artificial Sequence
  Synthetic
  misc_feature (20)..(21): 2'-O-methyl
ugaccacauuuauaucaucuu

SEQ ID NO: 2898 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccggcuauuguagaagcugtt

SEQ ID NO: 2899 - RNA, 21 nt, Artificial Sequence
  Synthetic
  misc_feature (20)..(21): 2'-O-methyl
cagcuucuacaauagccgguu

SEQ ID NO: 2900 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauaagccggcuauuguagtt

SEQ ID NO: 2901 - RNA, 21 nt, Artificial Sequence
  Synthetic
  misc_feature (20)..(21): 2'-O-methyl
cuacaauagccggcuuauuuu

SEQ ID NO: 2902 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucagcuucuggguucagautt

SEQ ID NO: 2903 - RNA, 21 nt, Artificial Sequence
  Synthetic
  misc_feature (20)..(21): 2'-O-methyl
aucugaacccagaagcugauu

SEQ ID NO: 2904 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuguaugagugggaacagtt

SEQ ID NO: 2905 - RNA, 21 nt, Artificial Sequence
  Synthetic
  misc_feature (20)..(21): 2'-O-methyl
cuguucccacucauacagguu

SEQ ID NO: 2906 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacucaagaacaaguagcutt

SEQ ID NO: 2907 - RNA, 21 nt, Artificial Sequence
  Synthetic
  misc_feature (20)..(21): 2'-O-methyl
agcuacuuguucuugaguguu

SEQ ID NO: 2908 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuucacauccuagcucggtt

SEQ ID NO: 2909 - RNA, 21 nt, Artificial Sequence
  Synthetic
  misc_feature (20)..(21): 2'-O-methyl
ccgagcuaggaugugaagguu

SEQ ID NO: 2910 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcaccuuugcgugagcatt

SEQ ID NO: 2911 - RNA, 21 nt, Artificial Sequence
  Synthetic
  misc_feature (20)..(21): 2'-O-methyl
ugcucacgcaaaggugcauuu

SEQ ID NO: 2912 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguucgugcacaucaggautt

SEQ ID NO: 2913 - RNA, 21 nt, Artificial Sequence
  Synthetic
  misc_feature (20)..(21): 2'-O-methyl
auccugaugugcacgaacauu

SEQ ID NO: 2914 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaguugcuuguucgugcatt

SEQ ID NO: 2915 - RNA, 21 nt, Artificial Sequence
  Synthetic
  misc_feature (20)..(21): 2'-O-methyl
ugcacgaacaagcaacugauu

SEQ ID NO: 2916 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuauccaguugaugggcutt

SEQ ID NO: 2917 - RNA, 21 nt, Artificial Sequence
  Synthetic
  misc_feature (20)..(21): 2'-O-methyl
agcccaucaacuggauaguuu

SEQ ID NO: 2918 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccgcaaaucaugcaccuutt

SEQ ID NO: 2919 - RNA, 21 nt, Artificial Sequence
  Synthetic
  misc_feature (20)..(21): 2'-O-methyl
aaggugcaugauuugcggguu

SEQ ID NO: 2920 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugauuugauggaguuggtt

SEQ ID NO: 2921 - RNA, 21 nt, Artificial Sequence
  Synthetic
  misc_feature (20)..(21): 2'-O-methyl
ccaacuccaucaaaucagcuu

SEQ ID NO: 2922 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auagaggcucuugugcguatt

SEQ ID NO: 2923 - RNA, 21 nt, Artificial Sequence
  Synthetic
  misc_feature (20)..(21): 2'-O-methyl
uacgcacaagagccucuauuu

SEQ ID NO: 2924 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caggacaaggaagcugcagtt

SEQ ID NO: 2925 - RNA, 21 nt, Artificial Sequence
  Synthetic
  misc_feature (20)..(21): 2'-O-methyl
cugcagcuuccuuguccuguu

SEQ ID NO: 2926 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggcugaaccaucacagautt

SEQ ID NO: 2927 - RNA, 21 nt, Artificial Sequence
  Synthetic
  misc_feature (20)..(21): 2'-O-methyl
aucugugaugguucagccauu

SEQ ID NO: 2928 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcucuuacacccaccauctt

SEQ ID NO: 2929 - RNA, 21 nt, Artificial Sequence
  Synthetic
  misc_feature (20)..(21): 2'-O-methyl
gaugguggguguaagagcuuu

SEQ ID NO: 2930 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caucacagaugcugaaacatt

SEQ ID NO: 2931 - RNA, 21 nt, Artificial Sequence
  Synthetic
  misc_feature (20)..(21): 2'-O-methyl
uguuucagcaucugugauguu

SEQ ID NO: 2932 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuauuguagaagcugguggtt

SEQ ID NO: 2933 - RNA, 21 nt, Artificial Sequence
  Synthetic
  misc_feature (20)..(21): 2'-O-methyl
ccaccagcuucuacaauaguu

SEQ ID NO: 2934 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcccaggaccucauggatt

SEQ ID NO: 2935 - RNA, 21 nt, Artificial Sequence
  Synthetic
  misc_feature (20)..(21): 2'-O-methyl
uccaugagguccugggcauuu

SEQ ID NO: 2936 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugacucgagcucagagggutt

SEQ ID NO: 2937 - RNA, 21 nt, Artificial Sequence
  Synthetic
  misc_feature (20)..(21): 2'-O-methyl
acccucugagcucgagucauu

SEQ ID NO: 2938 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguuugaugcugcucaucctt

SEQ ID NO: 2939 - RNA, 21 nt, Artificial Sequence
  Synthetic
  misc_feature (20)..(21): 2'-O-methyl
ggaugagcagcaucaaacuuu

SEQ ID NO: 2940 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccuucgggcuggugacagtt

SEQ ID NO: 2941 - RNA, 21 nt, Artificial Sequence
  Synthetic
  misc_feature (20)..(21): 2'-O-methyl
cugucaccagcccgaaggauu

SEQ ID NO: 2942 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augaagguguggcgacauatt

SEQ ID NO: 2943 - RNA, 21 nt, Artificial Sequence
  Synthetic
  misc_feature (20)..(21): 2'-O-methyl
uaugucgccacaccuucauuu

SEQ ID NO: 2944 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguugagcugaccagcucutt

SEQ ID NO: 2945 - RNA, 21 nt, Artificial Sequence
  Synthetic
  misc_feature (20)..(21): 2'-O-methyl
agagcuggucagcucaacuuu

SEQ ID NO: 2946 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauguggucaccugugcagtt

SEQ ID NO: 2947 - RNA, 21 nt, Artificial Sequence
  Synthetic
  misc_feature (20)..(21): 2'-O-methyl
cugcacaggugaccacauuuu

SEQ ID NO: 2948 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuguaugagugggaacaggtt

SEQ ID NO: 2949 - RNA, 21 nt, Artificial Sequence
  Synthetic
  misc_feature (20)..(21): 2'-O-methyl
ccuguucccacucauacaguu

SEQ ID NO: 2950 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucagaggguacgagcugctt

SEQ ID NO: 2951 - RNA, 21 nt, Artificial Sequence
  Synthetic
  misc_feature (20)..(21): 2'-O-methyl
gcagcucguacccucugaguu

SEQ ID NO: 2952 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcaauccugaggaagaggtt

SEQ ID NO: 2953 - RNA, 21 nt, Artificial Sequence
  Synthetic
  misc_feature (20)..(21): 2'-O-methyl
ccucuuccucaggauugccuu

SEQ ID NO: 2954 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuucgucaucugaccagctt

SEQ ID NO: 2955 - RNA, 21 nt, Artificial Sequence
  Synthetic
  misc_feature (20)..(21): 2'-O-methyl
gcuggucagaugacgaagauu

SEQ ID NO: 2956 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauacuggcuagugguggatt

SEQ ID NO: 2957 - RNA, 21 nt, Artificial Sequence
  Synthetic
  misc_feature (20)..(21): 2'-O-methyl
uccaccacuagccaguauguu

SEQ ID NO: 2958 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaagccacaagauuacaatt

SEQ ID NO: 2959 - RNA, 21 nt, Artificial Sequence
  Synthetic
  misc_feature (20)..(21): 2'-O-methyl
uuguaaucuuguggcuuguuu

SEQ ID NO: 2960 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucuugugcguacugucctt

SEQ ID NO: 2961 - RNA, 21 nt, Artificial Sequence
  Synthetic
  misc_feature (20)..(21): 2'-O-methyl
ggacaguacgcacaagagcuu

SEQ ID NO: 2962 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auguggauaccucccaagutt

SEQ ID NO: 2963 - RNA, 21 nt, Artificial Sequence
  Synthetic
  misc_feature (20)..(21): 2'-O-methyl
acuugggagguauccacauuu

SEQ ID NO: 2964 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguuugugcagcugcuuutt

SEQ ID NO: 2965 - RNA, 21 nt, Artificial Sequence
  Synthetic
  misc_feature (20)..(21): 2'-O-methyl
aaagcagcugcacaaacaauu

SEQ ID NO: 2966 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acauaugcagcugcuguuutt

SEQ ID NO: 2967 - RNA, 21 nt, Artificial Sequence
  Synthetic
  misc_feature (20)..(21): 2'-O-methyl
aaacagcagcugcauauguuu

SEQ ID NO: 2968 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauccaguugaugggcugctt

SEQ ID NO: 2969 - RNA, 21 nt, Artificial Sequence
  Synthetic
  misc_feature (20)..(21): 2'-O-methyl
gcagcccaucaacuggauauu

SEQ ID NO: 2970 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaguccuucacucaagaatt

SEQ ID NO: 2971 - RNA, 21 nt, Artificial Sequence
  Synthetic
  misc_feature (20)..(21): 2'-O-methyl
uucuugagugaaggacugauu

SEQ ID NO: 2972 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accuugcauaaccuuuccctt

SEQ ID NO: 2973 - RNA, 21 nt, Artificial Sequence
  Synthetic
  misc_feature (20)..(21): 2'-O-methyl
gggaaagguuaugcaagguuu

SEQ ID NO: 2974 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcgacauaugcagcugcutt

SEQ ID NO: 2975 - RNA, 21 nt, Artificial Sequence
  Synthetic
  misc_feature (20)..(21): 2'-O-methyl
agcagcugcauaugucgccuu

SEQ ID NO: 2976 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggugucugcuauuguacgtt

SEQ ID NO: 2977 - RNA, 21 nt, Artificial Sequence
  Synthetic
  misc_feature (20)..(21): 2'-O-methyl
cguacaauagcagacaccauu

SEQ ID NO: 2978 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucccugagacauuagautt

SEQ ID NO: 2979 - RNA, 21 nt, Artificial Sequence
  Synthetic
  misc_feature (20)..(21): 2'-O-methyl
aucuaaugucucagggaacuu

SEQ ID NO: 2980 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucaucccacuaaugucctt

SEQ ID NO: 2981 - RNA, 21 nt, Artificial Sequence
  Synthetic
  misc_feature (20)..(21): 2'-O-methyl
ggacauuagugggaugagcuu

SEQ ID NO: 2982 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaaaggcuacuguuggautt

SEQ ID NO: 2983 - RNA, 21 nt, Artificial Sequence
  Synthetic
  misc_feature (20)..(21): 2'-O-methyl
auccaacaguagccuuuauuu

SEQ ID NO: 2984 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugccauuccacgacuagutt

SEQ ID NO: 2985 - RNA, 21 nt, Artificial Sequence
  Synthetic
  misc_feature (20)..(21): 2'-O-methyl
acuagucguggaauggcacuu

SEQ ID NO: 2986 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugggugguauagaggcucutt

SEQ ID NO: 2987 - RNA, 21 nt, Artificial Sequence
  Synthetic
  misc_feature (20)..(21): 2'-O-methyl
agagccucuauaccacccauu

SEQ ID NO: 2988 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggccaucuuuaagucuggatt

SEQ ID NO: 2989 - RNA, 21 nt, Artificial Sequence
  Synthetic
  misc_feature (20)..(21): 2'-O-methyl
uccagacuuaaagauggccuu

SEQ ID NO: 2990 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauuggugcccagggagaatt

SEQ ID NO: 2991 - RNA, 21 nt, Artificial Sequence
  Synthetic
  misc_feature (20)..(21): 2'-O-methyl
uucucccugggcaccaauauu

SEQ ID NO: 2992 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucgagcucagaggguacgtt

SEQ ID NO: 2993 - RNA, 21 nt, Artificial Sequence
  Synthetic
  misc_feature (20)..(21): 2'-O-methyl
cguacccucugagcucgaguu

SEQ ID NO: 2994 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaacuugccacacgugcatt

SEQ ID NO: 2995 - RNA, 21 nt, Artificial Sequence
  Synthetic
  misc_feature (20)..(21): 2'-O-methyl
ugcacguguggcaaguucuuu

SEQ ID NO: 2996 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaccaguugugguuaagcutt

SEQ ID NO: 2997 - RNA, 21 nt, Artificial Sequence
  Synthetic
  misc_feature (20)..(21): 2'-O-methyl
agcuuaaccacaacugguauu

SEQ ID NO: 2998 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cguuuggcugaaccaucactt

SEQ ID NO: 2999 - RNA, 21 nt, Artificial Sequence
  Synthetic
  misc_feature (20)..(21): 2'-O-methyl
gugaugguucagccaaacguu

SEQ ID NO: 3000 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuauuguagaagcuggugtt

SEQ ID NO: 3001 - RNA, 21 nt, Artificial Sequence
  Synthetic
  misc_feature (20)..(21): 2'-O-methyl
caccagcuucuacaauagcuu

SEQ ID NO: 3002 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaggcauuccugcccuggtt

SEQ ID NO: 3003 - RNA, 21 nt, Artificial Sequence
  Synthetic
  misc_feature (20)..(21): 2'-O-methyl
ccagggcaggaaugccuccuu

SEQ ID NO: 3004 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accacccuggugcugacuatt

SEQ ID NO: 3005 - RNA, 21 nt, Artificial Sequence
  Synthetic
  misc_feature (20)..(21): 2'-O-methyl
uagucagcaccagggugguuu

SEQ ID NO: 3006 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaucuugcccuuugucccgtt

SEQ ID NO: 3007 - RNA, 21 nt, Artificial Sequence
  Synthetic
  misc_feature (20)..(21): 2'-O-methyl
cgggacaaagggcaagauuuu

SEQ ID NO: 3008 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cguuuagcuggugggcugctt

SEQ ID NO: 3009 - RNA, 21 nt, Artificial Sequence
  Synthetic
  misc_feature (20)..(21): 2'-O-methyl
gcagcccaccagcuaaacguu

SEQ ID NO: 3010 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguugagcugaccagcuctt

SEQ ID NO: 3011 - RNA, 21 nt, Artificial Sequence
  Synthetic
  misc_feature (20)..(21): 2'-O-methyl
gagcuggucagcucaacuguu

SEQ ID NO: 3012 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauauaaauguggucacctt

SEQ ID NO: 3013 - RNA, 21 nt, Artificial Sequence
  Synthetic
  misc_feature (20)..(21): 2'-O-methyl
ggugaccacauuuauaucauu

SEQ ID NO: 3014 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugagugguaaaggcaauctt

SEQ ID NO: 3015 - RNA, 21 nt, Artificial Sequence
  Synthetic
  misc_feature (20)..(21): 2'-O-methyl
gauugccuuuaccacucaguu

SEQ ID NO: 3016 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaggugcuaucugucugcutt

SEQ ID NO: 3017 - RNA, 21 nt, Artificial Sequence
  Synthetic
  misc_feature (20)..(21): 2'-O-methyl
agcagacagauagcaccuuuu

SEQ ID NO: 3018 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccuagcucgggauguucatt

SEQ ID NO: 3019 - RNA, 21 nt, Artificial Sequence
  Synthetic
  misc_feature (20)..(21): 2'-O-methyl
ugaacaucccgagcuaggauu

SEQ ID NO: 3020 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucugcuauuguacguacctt

SEQ ID NO: 3021 - RNA, 21 nt, Artificial Sequence
  Synthetic
  misc_feature (20)..(21): 2'-O-methyl
gguacguacaauagcagacuu

SEQ ID NO: 3022 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaagcugauuugauggagtt

SEQ ID NO: 3023 - RNA, 21 nt, Artificial Sequence
  Synthetic
  misc_feature (20)..(21): 2'-O-methyl
cuccaucaaaucagcuugauu

SEQ ID NO: 3024 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccagcucucucuucagaactt

SEQ ID NO: 3025 - RNA, 21 nt, Artificial Sequence
  Synthetic
  misc_feature (20)..(21): 2'-O-methyl
guucugaagagagagcugguu

SEQ ID NO: 3026 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acauggccauggaaccagatt

SEQ ID NO: 3027 - RNA, 21 nt, Artificial Sequence
  Synthetic
  misc_feature (20)..(21): 2'-O-methyl
ucugguuccauggccauguuu

SEQ ID NO: 3028 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacccagcgccguacgucctt

SEQ ID NO: 3029 - RNA, 21 nt, Artificial Sequence
  Synthetic
  misc_feature (20)..(21): 2'-O-methyl
ggacguacggcgcuggguauu

SEQ ID NO: 3030 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaguugaagguuguaccgtt

SEQ ID NO: 3031 - RNA, 21 nt, Artificial Sequence
  Synthetic
  misc_feature (20)..(21): 2'-O-methyl
cgguacaaccuucaacuauuu

SEQ ID NO: 3032 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcuuuaggacuucaccugtt

SEQ ID NO: 3033 - RNA, 21 nt, Artificial Sequence
  Synthetic
  misc_feature (20)..(21): 2'-O-methyl
caggugaaguccuaaagcuuu

SEQ ID NO: 3034 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acauccaaagaguagcugctt

SEQ ID NO: 3035 - RNA, 21 nt, Artificial Sequence
  Synthetic
  misc_feature (20)..(21): 2'-O-methyl
gcagcuacucuuuggauguuu

SEQ ID NO: 3036 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugcauaaccuuucccauctt

SEQ ID NO: 3037 - RNA, 21 nt, Artificial Sequence
  Synthetic
  misc_feature (20)..(21): 2'-O-methyl
gaugggaaagguuaugcaauu

SEQ ID NO: 3038 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggcccagaaugcaguucgtt

SEQ ID NO: 3039 - RNA, 21 nt, Artificial Sequence
  Synthetic
  misc_feature (20)..(21): 2'-O-methyl
cgaacugcauucugggccauu

SEQ ID NO: 3040 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auucgaaaucuugcccuuutt

SEQ ID NO: 3041 - RNA, 21 nt, Artificial Sequence
  Synthetic
  misc_feature (20)..(21): 2'-O-methyl
aaagggcaagauuucgaauuu

SEQ ID NO: 3042 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaagccggcuauuguagatt

SEQ ID NO: 3043 - RNA, 21 nt, Artificial Sequence
  Synthetic
  misc_feature (20)..(21): 2'-O-methyl
ucuacaauagccggcuuauuu

SEQ ID NO: 3044 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgacagacugccuucaaautt

SEQ ID NO: 3045 - RNA, 21 nt, Artificial Sequence
  Synthetic
  misc_feature (20)..(21): 2'-O-methyl
auuugaaggcagucugucguu

SEQ ID NO: 3046 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcaguuaugguccaucagtt

SEQ ID NO: 3047 - RNA, 21 nt, Artificial Sequence
  Synthetic
  misc_feature (20)..(21): 2'-O-methyl
cugauggaccauaacugcauu

SEQ ID NO: 3048 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuugaugcugcucauccctt

SEQ ID NO: 3049 - RNA, 21 nt, Artificial Sequence
  Synthetic
  misc_feature (20)..(21): 2'-O-methyl
gggaugagcagcaucaaacuu

SEQ ID NO: 3050 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaauguccagcguuuggctt

SEQ ID NO: 3051 - RNA, 21 nt, Artificial Sequence
  Synthetic
  misc_feature (20)..(21): 2'-O-methyl
gccaaacgcuggacauuaguu

SEQ ID NO: 3052 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaguagcugauauugaugtt

SEQ ID NO: 3053 - RNA, 21 nt, Artificial Sequence
  Synthetic
  misc_feature (20)..(21): 2'-O-methyl
caucaauaucagcuacuuguu

SEQ ID NO: 3054 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugacagaguuacuucactt

SEQ ID NO: 3055 - RNA, 21 nt, Artificial Sequence
  Synthetic
  misc_feature (20)..(21): 2'-O-methyl
gugaaguaacucugucagauu

SEQ ID NO: 3056 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugguauagaggcucuugtt

SEQ ID NO: 3057 - RNA, 21 nt, Artificial Sequence
  Synthetic
  misc_feature (20)..(21): 2'-O-methyl
caagagccucuauaccaccuu

SEQ ID NO: 3058 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaccagguggugguuaauatt

SEQ ID NO: 3059 - RNA, 21 nt, Artificial Sequence
  Synthetic
  misc_feature (20)..(21): 2'-O-methyl
uauuaaccaccaccuggucuu

SEQ ID NO: 3060 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccucauggaugggcugccutt

SEQ ID NO: 3061 - RNA, 21 nt, Artificial Sequence
  Synthetic
  misc_feature (20)..(21): 2'-O-methyl
aggcagcccauccaugagguu

SEQ ID NO: 3062 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugucuuuggacucucaggatt

SEQ ID NO: 3063 - RNA, 21 nt, Artificial Sequence
  Synthetic
  misc_feature (20)..(21): 2'-O-methyl
uccugagaguccaaagacauu

SEQ ID NO: 3064 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaacaaguagcugauauugtt

SEQ ID NO: 3065 - RNA, 21 nt, Artificial Sequence
  Synthetic
  misc_feature (20)..(21): 2'-O-methyl
caauaucagcuacuuguucuu

SEQ ID NO: 3066 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugccacuaccacagcucctt

SEQ ID NO: 3067 - RNA, 21 nt, Artificial Sequence
  Synthetic
  misc_feature (20)..(21): 2'-O-methyl
ggagcugugguaguggcacuu

SEQ ID NO: 3068 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaccuuugcgugagcaggtt

SEQ ID NO: 3069 - RNA, 21 nt, Artificial Sequence
  Synthetic
  misc_feature (20)..(21): 2'-O-methyl
ccugcucacgcaaaggugcuu

SEQ ID NO: 3070 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacuucaccugacagaucctt

SEQ ID NO: 3071 - RNA, 21 nt, Artificial Sequence
  Synthetic
  misc_feature (20)..(21): 2'-O-methyl
ggaucugucaggugaagucuu

SEQ ID NO: 3072 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaauaccauuccauuguuutt

SEQ ID NO: 3073 - RNA, 21 nt, Artificial Sequence
  Synthetic
  misc_feature (20)..(21): 2'-O-methyl
aaacaauggaaugguauuuuu

SEQ ID NO: 3074 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucaagaacaaguagcugatt

SEQ ID NO: 3075 - RNA, 21 nt, Artificial Sequence
  Synthetic
  misc_feature (20)..(21): 2'-O-methyl
ucagcuacuuguucuugaguu

SEQ ID NO: 3076 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caugcguucuccucagaugtt

SEQ ID NO: 3077 - RNA, 21 nt, Artificial Sequence
  Synthetic
  misc_feature (20)..(21): 2'-O-methyl
caucugaggagaacgcauguu

SEQ ID NO: 3078 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccucugugaacuugcucatt

SEQ ID NO: 3079 - RNA, 21 nt, Artificial Sequence
  Synthetic
  misc_feature (20)..(21): 2'-O-methyl
ugagcaaguucacagaggauu

SEQ ID NO: 3080 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuggaggcauuccugccctt

SEQ ID NO: 3081 - RNA, 21 nt, Artificial Sequence
  Synthetic
  misc_feature (20)..(21): 2'-O-methyl
gggcaggaaugccuccagauu

SEQ ID NO: 3082 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagucuggaggcauuccugtt

SEQ ID NO: 3083 - RNA, 21 nt, Artificial Sequence
  Synthetic
  misc_feature (20)..(21): 2'-O-methyl
caggaaugccuccagacuuuu

SEQ ID NO: 3084 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugaagguuguaccggagctt

SEQ ID NO: 3085 - RNA, 21 nt, Artificial Sequence
  Synthetic
  misc_feature (20)..(21): 2'-O-methyl
gcuccgguacaaccuucaauu

SEQ ID NO: 3086 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acauccuagcucgggaugutt

SEQ ID NO: 3087 - RNA, 21 nt, Artificial Sequence
  Synthetic
  misc_feature (20)..(21): 2'-O-methyl
acaucccgagcuaggauguuu

SEQ ID NO: 3088 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accaagaaagcaagcucautt

SEQ ID NO: 3089 - RNA, 21 nt, Artificial Sequence
  Synthetic
  misc_feature (20)..(21): 2'-O-methyl
augagcuugcuuucuugguuu

SEQ ID NO: 3090 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuuggcugaaccaucacagtt

SEQ ID NO: 3091 - RNA, 21 nt, Artificial Sequence
  Synthetic
  misc_feature (20)..(21): 2'-O-methyl
cugugaugguucagccaaauu

SEQ ID NO: 3092 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacacgugcaaucccugaatt

SEQ ID NO: 3093 - RNA, 21 nt, Artificial Sequence
  Synthetic
  misc_feature (20)..(21): 2'-O-methyl
uucagggauugcacguguguu

SEQ ID NO: 3094 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucaucauacuggcuagutt

SEQ ID NO: 3095 - RNA, 21 nt, Artificial Sequence
  Synthetic
  misc_feature (20)..(21): 2'-O-methyl
acuagccaguaugaugagcuu

SEQ ID NO: 3096 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggguaggguaaaucaguaatt

SEQ ID NO: 3097 - RNA, 21 nt, Artificial Sequence
  Synthetic
  misc_feature (20)..(21): 2'-O-methyl
uuacugauuuacccuacccuu

SEQ ID NO: 3098 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucaccugacagauccaagtt

SEQ ID NO: 3099 - RNA, 21 nt, Artificial Sequence
  Synthetic
  misc_feature (20)..(21): 2'-O-methyl
cuuggaucugucaggugaauu

SEQ ID NO: 3100 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaaucuuucagaugcugtt

SEQ ID NO: 3101 - RNA, 21 nt, Artificial Sequence
  Synthetic
  misc_feature (20)..(21): 2'-O-methyl
cagcaucugaaagauuccuuu

SEQ ID NO: 3102 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuguacguaccaugcagatt

SEQ ID NO: 3103 - RNA, 21 nt, Artificial Sequence
  Synthetic
  misc_feature (20)..(21): 2'-O-methyl
ucugcaugguacguacaauuu

SEQ ID NO: 3104 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguaaaggcaauccugagtt

SEQ ID NO: 3105 - RNA, 21 nt, Artificial Sequence
  Synthetic
  misc_feature (20)..(21): 2'-O-methyl
cucaggauugccuuuaccauu

SEQ ID NO: 3106 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauucuuggcuauuacgactt

SEQ ID NO: 3107 - RNA, 21 nt, Artificial Sequence
  Synthetic
  misc_feature (20)..(21): 2'-O-methyl
gucguaauagccaagaauuuu

SEQ ID NO: 3108 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauccuagcuaucguucuutt

SEQ ID NO: 3109 - RNA, 21 nt, Artificial Sequence
  Synthetic
  misc_feature (20)..(21): 2'-O-methyl
aagaacgauagcuaggaucuu

SEQ ID NO: 3110 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucgucaucugaccagccgtt

SEQ ID NO: 3111 - RNA, 21 nt, Artificial Sequence
  Synthetic
  misc_feature (20)..(21): 2'-O-methyl
cggcuggucagaugacgaauu

SEQ ID NO: 3112 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaucuuucagaugcugcaatt

SEQ ID NO: 3113 - RNA, 21 nt, Artificial Sequence
  Synthetic
  misc_feature (20)..(21): 2'-O-methyl
uugcagcaucugaaagauuuu

SEQ ID NO: 3114 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcaguucgccuucacuautt

SEQ ID NO: 3115 - RNA, 21 nt, Artificial Sequence
  Synthetic
  misc_feature (20)..(21): 2'-O-methyl
auagugaaggcgaacugcauu

SEQ ID NO: 3116 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaugauccuagcuaucgtt

SEQ ID NO: 3117 - RNA, 21 nt, Artificial Sequence
  Synthetic
  misc_feature (20)..(21): 2'-O-methyl
cgauagcuaggaucauccuuu

SEQ ID NO: 3118 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagcucucucuucagaacatt

SEQ ID NO: 3119 - RNA, 21 nt, Artificial Sequence
  Synthetic
  misc_feature (20)..(21): 2'-O-methyl
uguucugaagagagagcuguu

SEQ ID NO: 3120 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugggacacagcagcaautt

SEQ ID NO: 3121 - RNA, 21 nt, Artificial Sequence
  Synthetic
  misc_feature (20)..(21): 2'-O-methyl
auugcugcugugucccaccuu

SEQ ID NO: 3122 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caggaugauccuagcuauctt

SEQ ID NO: 3123 - RNA, 21 nt, Artificial Sequence
  Synthetic
  misc_feature (20)..(21): 2'-O-methyl
gauagcuaggaucauccuguu

SEQ ID NO: 3124 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaagaggauguggauactt

SEQ ID NO: 3125 - RNA, 21 nt, Artificial Sequence
  Synthetic
  misc_feature (20)..(21): 2'-O-methyl
guauccacauccucuuccuuu

SEQ ID NO: 3126 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucugucugcucuaguaautt

SEQ ID NO: 3127 - RNA, 21 nt, Artificial Sequence
  Synthetic
  misc_feature (20)..(21): 2'-O-methyl
auuacuagagcagacagauuu

SEQ ID NO: 3128 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaccuuucccaucaucgutt

SEQ ID NO: 3129 - RNA, 21 nt, Artificial Sequence
  Synthetic
  misc_feature (20)..(21): 2'-O-methyl
acgaugaugggaaagguuauu

SEQ ID NO: 3130 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcuuuauucucccauugtt

SEQ ID NO: 3131 - RNA, 21 nt, Artificial Sequence
  Synthetic
  misc_feature (20)..(21): 2'-O-methyl
caaugggagaauaaagcaguu

SEQ ID NO: 3132 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauuguaaucugaauaaagtt

SEQ ID NO: 3133 - RNA, 21 nt, Artificial Sequence
  Synthetic
  misc_feature (20)..(21): 2'-O-methyl
cuuuauucagauuacaauuuu

SEQ ID NO: 3134 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuuguucagcuucugggutt

SEQ ID NO: 3135 - RNA, 21 nt, Artificial Sequence
  Synthetic
  misc_feature (20)..(21): 2'-O-methyl
acccagaagcugaacaagauu

SEQ ID NO: 3136 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucgugcacaucaggauatt

SEQ ID NO: 3137 - RNA, 21 nt, Artificial Sequence
  Synthetic
  misc_feature (20)..(21): 2'-O-methyl
uauccugaugugcacgaacuu

SEQ ID NO: 3138 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augaugcagaacuugccactt

SEQ ID NO: 3139 - RNA, 21 nt, Artificial Sequence
  Synthetic
  misc_feature (20)..(21): 2'-O-methyl
guggcaaguucugcaucauuu

SEQ ID NO: 3140 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugauauugauggacagutt

SEQ ID NO: 3141 - RNA, 21 nt, Artificial Sequence
  Synthetic
  misc_feature (20)..(21): 2'-O-methyl
acuguccaucaauaucagcuu

SEQ ID NO: 3142 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguuaagcucuuacacccatt

SEQ ID NO: 3143 - RNA, 21 nt, Artificial Sequence
  Synthetic
  misc_feature (20)..(21): 2'-O-methyl
uggguguaagagcuuaaccuu

SEQ ID NO: 3144 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcccuuugucccgcaaauctt

SEQ ID NO: 3145 - RNA, 21 nt, Artificial Sequence
  Synthetic
  misc_feature (20)..(21): 2'-O-methyl
gauuugcgggacaaagggcuu

SEQ ID NO: 3146 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucagaggguacgagcugcutt

SEQ ID NO: 3147 - RNA, 21 nt, Artificial Sequence
  Synthetic
  misc_feature (20)..(21): 2'-O-methyl
agcagcucguacccucugauu

SEQ ID NO: 3148 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacaaaugauguagaaacatt

SEQ ID NO: 3149 - RNA, 21 nt, Artificial Sequence
  Synthetic
  misc_feature (20)..(21): 2'-O-methyl
uguuucuacaucauuuguauu

SEQ ID NO: 3150 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaacaugcaguuguaaacutt

SEQ ID NO: 3151 - RNA, 21 nt, Artificial Sequence
  Synthetic
  misc_feature (20)..(21): 2'-O-methyl
aguuuacaacugcauguuuuu

SEQ ID NO: 3152 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuugcccuuugucccgcaatt

SEQ ID NO: 3153 - RNA, 21 nt, Artificial Sequence
  Synthetic
  misc_feature (20)..(21): 2'-O-methyl
uugcgggacaaagggcaaguu

SEQ ID NO: 3154 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuacaagaaacggcuuucatt

SEQ ID NO: 3155 - RNA, 21 nt, Artificial Sequence
  Synthetic
  misc_feature (20)..(21): 2'-O-methyl
ugaaagccguuucuuguaauu

SEQ ID NO: 3156 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacucugguggauauggcctt

SEQ ID NO: 3157 - RNA, 21 nt, Artificial Sequence
  Synthetic
  misc_feature (20)..(21): 2'-O-methyl
ggccauauccaccagaguguu

SEQ ID NO: 3158 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caucuuuaagucuggaggctt

SEQ ID NO: 3159 - RNA, 21 nt, Artificial Sequence
  Synthetic
  misc_feature (20)..(21): 2'-O-methyl
gccuccagacuuaaagauguu

SEQ ID NO: 3160 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugccaucugugcucuucgutt

SEQ ID NO: 3161 - RNA, 21 nt, Artificial Sequence
  Synthetic
  misc_feature (20)..(21): 2'-O-methyl
acgaagagcacagauggcauu

SEQ ID NO: 3162 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuuggcuauuacgacagatt

SEQ ID NO: 3163 - RNA, 21 nt, Artificial Sequence
  Synthetic
  misc_feature (20)..(21): 2'-O-methyl
ucugucguaauagccaagauu

SEQ ID NO: 3164 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuugggauauguaugggutt

SEQ ID NO: 3165 - RNA, 21 nt, Artificial Sequence
  Synthetic
  misc_feature (20)..(21): 2'-O-methyl
acccauacauaucccaaauuu

SEQ ID NO: 3166 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguggauucuguguuguutt

SEQ ID NO: 3167 - RNA, 21 nt, Artificial Sequence
  Synthetic
  misc_feature (20)..(21): 2'-O-methyl
aacaacacagaauccacuguu

SEQ ID NO: 3168 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuucgggcuggugacaggtt

SEQ ID NO: 3169 - RNA, 21 nt, Artificial Sequence
  Synthetic
  misc_feature (20)..(21): 2'-O-methyl
ccugucaccagcccgaagguu

SEQ ID NO: 3170 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacacagcagcaauuugutt

SEQ ID NO: 3171 - RNA, 21 nt, Artificial Sequence
  Synthetic
  misc_feature (20)..(21): 2'-O-methyl
acaaauugcugcuguguccuu

SEQ ID NO: 3172 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccagcgccguacguccaugtt

SEQ ID NO: 3173 - RNA, 21 nt, Artificial Sequence
  Synthetic
  misc_feature (20)..(21): 2'-O-methyl
cauggacguacggcgcugguu

SEQ ID NO: 3174 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagaaacggcuuucaguugtt

SEQ ID NO: 3175 - RNA, 21 nt, Artificial Sequence
  Synthetic
  misc_feature (20)..(21): 2'-O-methyl
caacugaaagccguuucuuuu

SEQ ID NO: 3176 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuagaugagggcaugcagtt

SEQ ID NO: 3177 - RNA, 21 nt, Artificial Sequence
  Synthetic
  misc_feature (20)..(21): 2'-O-methyl
cugcaugcccucaucuaauuu

SEQ ID NO: 3178 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accagcucucucuucagaatt

SEQ ID NO: 3179 - RNA, 21 nt, Artificial Sequence
  Synthetic
  misc_feature (20)..(21): 2'-O-methyl
uucugaagagagagcugguuu

SEQ ID NO: 3180 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguuaugguccaucagcuutt

SEQ ID NO: 3181 - RNA, 21 nt, Artificial Sequence
  Synthetic
  misc_feature (20)..(21): 2'-O-methyl
aagcugauggaccauaacuuu

SEQ ID NO: 3182 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacuauccaguugaugggctt

SEQ ID NO: 3183 - RNA, 21 nt, Artificial Sequence
  Synthetic
  misc_feature (20)..(21): 2'-O-methyl
gcccaucaacuggauagucuu

SEQ ID NO: 3184 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcuugguucaccaguggtt

SEQ ID NO: 3185 - RNA, 21 nt, Artificial Sequence
  Synthetic
  misc_feature (20)..(21): 2'-O-methyl
ccacuggugaaccaagcauuu

SEQ ID NO: 3186 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuagcucgggauguucacatt

SEQ ID NO: 3187 - RNA, 21 nt, Artificial Sequence
  Synthetic
  misc_feature (20)..(21): 2'-O-methyl
ugugaacaucccgagcuaguu

SEQ ID NO: 3188 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucuuacacccaccauccctt

SEQ ID NO: 3189 - RNA, 21 nt, Artificial Sequence
  Synthetic
  misc_feature (20)..(21): 2'-O-methyl
gggaugguggguguaagaguu

SEQ ID NO: 3190 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuugcucaggacaaggaagtt

SEQ ID NO: 3191 - RNA, 21 nt, Artificial Sequence
  Synthetic
  misc_feature (20)..(21): 2'-O-methyl
cuuccuuguccugagcaaguu

SEQ ID NO: 3192 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agauuacaagaaacggcuutt

SEQ ID NO: 3193 - RNA, 21 nt, Artificial Sequence
  Synthetic
  misc_feature (20)..(21): 2'-O-methyl
aagccguuucuuguaaucuuu

SEQ ID NO: 3194 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accacagcuccuucucugatt

SEQ ID NO: 3195 - RNA, 21 nt, Artificial Sequence
  Synthetic
  misc_feature (20)..(21): 2'-O-methyl
ucagagaaggagcugugguuu

SEQ ID NO: 3196 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacuugccacacgugcaautt

SEQ ID NO: 3197 - RNA, 21 nt, Artificial Sequence
  Synthetic
  misc_feature (20)..(21): 2'-O-methyl
auugcacguguggcaaguuuu

SEQ ID NO: 3198 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaugcugcaacuaaacagtt

SEQ ID NO: 3199 - RNA, 21 nt, Artificial Sequence
  Synthetic
  misc_feature (20)..(21): 2'-O-methyl
cuguuuaguugcagcaucuuu

SEQ ID NO: 3200 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaaugaggaccuauacuutt

SEQ ID NO: 3201 - RNA, 21 nt, Artificial Sequence
  Synthetic
  misc_feature (20)..(21): 2'-O-methyl
aaguauagguccucauuauuu

SEQ ID NO: 3202 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuaagcucuuacacccacctt

SEQ ID NO: 3203 - RNA, 21 nt, Artificial Sequence
  Synthetic
  misc_feature (20)..(21): 2'-O-methyl
gguggguguaagagcuuaauu

SEQ ID NO: 3204 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauaaggcugcaguuauggtt

SEQ ID NO: 3205 - RNA, 21 nt, Artificial Sequence
  Synthetic
  misc_feature (20)..(21): 2'-O-methyl
ccauaacugcagccuuauuuu

SEQ ID NO: 3206 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugggauauguauggguagtt

SEQ ID NO: 3207 - RNA, 21 nt, Artificial Sequence
  Synthetic
  misc_feature (20)..(21): 2'-O-methyl
cuacccauacauaucccaauu

SEQ ID NO: 3208 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaaccugcugugauacgatt

SEQ ID NO: 3209 - RNA, 21 nt, Artificial Sequence
  Synthetic
  misc_feature (20)..(21): 2'-O-methyl
ucguaucacagcagguuacuu

SEQ ID NO: 3210 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggucugccaaguggguggtt

SEQ ID NO: 3211 - RNA, 21 nt, Artificial Sequence
  Synthetic
  misc_feature (20)..(21): 2'-O-methyl
ccacccacuuggcagaccauu

SEQ ID NO: 3212 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuucucugagugguaaagtt

SEQ ID NO: 3213 - RNA, 21 nt, Artificial Sequence
  Synthetic
  misc_feature (20)..(21): 2'-O-methyl
cuuuaccacucagagaagguu

SEQ ID NO: 3214 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagcuauugaagcugaggtt

SEQ ID NO: 3215 - RNA, 21 nt, Artificial Sequence
  Synthetic
  misc_feature (20)..(21): 2'-O-methyl
ccucagcuucaauagcuucuu

SEQ ID NO: 3216 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcagaacuugccacacgtt

SEQ ID NO: 3217 - RNA, 21 nt, Artificial Sequence
  Synthetic
  misc_feature (20)..(21): 2'-O-methyl
cguguggcaaguucugcauuu

SEQ ID NO: 3218 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guagcugauauugauggactt

SEQ ID NO: 3219 - RNA, 21 nt, Artificial Sequence
  Synthetic
  misc_feature (20)..(21): 2'-O-methyl
guccaucaauaucagcuacuu

SEQ ID NO: 3220 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucaagcugauuugauggatt

SEQ ID NO: 3221 - RNA, 21 nt, Artificial Sequence
  Synthetic
  misc_feature (20)..(21): 2'-O-methyl
uccaucaaaucagcuugaguu

SEQ ID NO: 3222 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcauggaagaaauaguugatt

SEQ ID NO: 3223 - RNA, 21 nt, Artificial Sequence
  Synthetic
  misc_feature (20)..(21): 2'-O-methyl
ucaacuauuucuuccaugcuu

SEQ ID NO: 3224 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugguggaaugcaagcuuutt

SEQ ID NO: 3225 - RNA, 21 nt, Artificial Sequence
  Synthetic
  misc_feature (20)..(21): 2'-O-methyl
aaagcuugcauuccaccaguu

SEQ ID NO: 3226 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccaggaccucauggauggtt

SEQ ID NO: 3227 - RNA, 21 nt, Artificial Sequence
  Synthetic
  misc_feature (20)..(21): 2'-O-methyl
ccauccaugagguccuggguu

SEQ ID NO: 3228 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuugggauauguauggguatt

SEQ ID NO: 3229 - RNA, 21 nt, Artificial Sequence
  Synthetic
  misc_feature (20)..(21): 2'-O-methyl
uacccauacauaucccaaauu

SEQ ID NO: 3230 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaaguuguuguaaccugctt

SEQ ID NO: 3231 - RNA, 21 nt, Artificial Sequence
  Synthetic
  misc_feature (20)..(21): 2'-O-methyl
gcagguuacaacaacuuuguu

SEQ ID NO: 3232 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccgaauuguuaucagaggatt

SEQ ID NO: 3233 - RNA, 21 nt, Artificial Sequence
  Synthetic
  misc_feature (20)..(21): 2'-O-methyl
uccucugauaacaauucgguu

SEQ ID NO: 3234 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaauuguaaucugaauaaatt

SEQ ID NO: 3235 - RNA, 21 nt, Artificial Sequence
  Synthetic
  misc_feature (20)..(21): 2'-O-methyl
uuuauucagauuacaauuauu

SEQ ID NO: 3236 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuguaaucugaauaaagutt

SEQ ID NO: 3237 - RNA, 21 nt, Artificial Sequence
  Synthetic
  misc_feature (20)..(21): 2'-O-methyl
acuuuauucagauuacaauuu

SEQ ID NO: 3238 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgaauuguuaucagaggactt

SEQ ID NO: 3239 - RNA, 21 nt, Artificial Sequence
  Synthetic
  misc_feature (20)..(21): 2'-O-methyl
guccucugauaacaauucguu

SEQ ID NO: 3240 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaaguccuguaugaguggtt

SEQ ID NO: 3241 - RNA, 21 nt, Artificial Sequence
  Synthetic
  misc_feature (20)..(21): 2'-O-methyl
ccacucauacaggacuugguu

SEQ ID NO: 3242 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagccggcuauuguagaagtt

SEQ ID NO: 3243 - RNA, 21 nt, Artificial Sequence
  Synthetic
  misc_feature (20)..(21): 2'-O-methyl
cuucuacaauagccggcuuuu

SEQ ID NO: 3244 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaauaguugaagguuguatt

SEQ ID NO: 3245 - RNA, 21 nt, Artificial Sequence
  Synthetic
  misc_feature (20)..(21): 2'-O-methyl
uacaaccuucaacuauuucuu

SEQ ID NO: 3246 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccuagcuaucguucuuutt

SEQ ID NO: 3247 - RNA, 21 nt, Artificial Sequence
  Synthetic
  misc_feature (20)..(21): 2'-O-methyl
aaagaacgauagcuaggauuu

SEQ ID NO: 3248 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaaccuuucccaucaucgtt

SEQ ID NO: 3249 - RNA, 21 nt, Artificial Sequence
  Synthetic
  misc_feature (20)..(21): 2'-O-methyl
cgaugaugggaaagguuauuu

SEQ ID NO: 3250 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccaagugggugguauagatt

SEQ ID NO: 3251 - RNA, 21 nt, Artificial Sequence
  Synthetic
  misc_feature (20)..(21): 2'-O-methyl
ucuauaccacccacuuggcuu

SEQ ID NO: 3252 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgacuaguucaguugcuugtt

SEQ ID NO: 3253 - RNA, 21 nt, Artificial Sequence
  Synthetic
  misc_feature (20)..(21): 2'-O-methyl
caagcaacugaacuagucguu

SEQ ID NO: 3254 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugguucaccaguggauuctt

SEQ ID NO: 3255 - RNA, 21 nt, Artificial Sequence
  Synthetic
  misc_feature (20)..(21): 2'-O-methyl
gaauccacuggugaaccaauu

SEQ ID NO: 3256 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucagaacugucuuuggatt

SEQ ID NO: 3257 - RNA, 21 nt, Artificial Sequence
  Synthetic
  misc_feature (20)..(21): 2'-O-methyl
uccaaagacaguucugaacuu

SEQ ID NO: 3258 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcugugauacgaugcuuctt

SEQ ID NO: 3259 - RNA, 21 nt, Artificial Sequence
  Synthetic
  misc_feature (20)..(21): 2'-O-methyl
gaagcaucguaucacagcauu

SEQ ID NO: 3260 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccaggugacagcaaucagtt

SEQ ID NO: 3261 - RNA, 21 nt, Artificial Sequence
  Synthetic
  misc_feature (20)..(21): 2'-O-methyl
cugauugcugucaccuggauu

SEQ ID NO: 3262 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaugguccaucagcuuucutt

SEQ ID NO: 3263 - RNA, 21 nt, Artificial Sequence
  Synthetic
  misc_feature (20)..(21): 2'-O-methyl
agaaagcugauggaccauauu

SEQ ID NO: 3264 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugccauuccacgacuaguutt

SEQ ID NO: 3265 - RNA, 21 nt, Artificial Sequence
  Synthetic
  misc_feature (20)..(21): 2'-O-methyl
aacuagucguggaauggcauu

SEQ ID NO: 3266 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaccaagaaagcaagcucatt

SEQ ID NO: 3267 - RNA, 21 nt, Artificial Sequence
  Synthetic
  misc_feature (20)..(21): 2'-O-methyl
ugagcuugcuuucuugguuuu

SEQ ID NO: 3268 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaauuauaagaacaagautt

SEQ ID NO: 3269 - RNA, 21 nt, Artificial Sequence
  Synthetic
  misc_feature (20)..(21): 2'-O-methyl
aucuuguucuuauaauuauuu

SEQ ID NO: 3270 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuaagcucuuacacccactt

SEQ ID NO: 3271 - RNA, 21 nt, Artificial Sequence
  Synthetic
  misc_feature (20)..(21): 2'-O-methyl
guggguguaagagcuuaacuu

SEQ ID NO: 3272 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugaguaaugguguagaactt

SEQ ID NO: 3273 - RNA, 21 nt, Artificial Sequence
  Synthetic
  misc_feature (20)..(21): 2'-O-methyl
guucuacaccauuacucaauu

SEQ ID NO: 3274 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guguggcgacauaugcagctt

SEQ ID NO: 3275 - RNA, 21 nt, Artificial Sequence
  Synthetic
  misc_feature (20)..(21): 2'-O-methyl
gcugcauaugucgccacacuu

SEQ ID NO: 3276 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaccagcucucucuucagatt

SEQ ID NO: 3277 - RNA, 21 nt, Artificial Sequence
  Synthetic
  misc_feature (20)..(21): 2'-O-methyl
ucugaagagagagcuggucuu

SEQ ID NO: 3278 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguaccggagcccuucactt

SEQ ID NO: 3279 - RNA, 21 nt, Artificial Sequence
  Synthetic
  misc_feature (20)..(21): 2'-O-methyl
gugaagggcuccgguacaauu

SEQ ID NO: 3280 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggccauggaaccagacatt

SEQ ID NO: 3281 - RNA, 21 nt, Artificial Sequence
  Synthetic
  misc_feature (20)..(21): 2'-O-methyl
ugucugguuccauggccauuu

SEQ ID NO: 3282 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguggauauggccaggautt

SEQ ID NO: 3283 - RNA, 21 nt, Artificial Sequence
  Synthetic
  misc_feature (20)..(21): 2'-O-methyl
auccuggccauauccaccauu

SEQ ID NO: 3284 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccucugacagaguuacuuctt

SEQ ID NO: 3285 - RNA, 21 nt, Artificial Sequence
  Synthetic
  misc_feature (20)..(21): 2'-O-methyl
gaaguaacucugucagagguu

SEQ ID NO: 3286 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augauccuagcuaucguuctt

SEQ ID NO: 3287 - RNA, 21 nt, Artificial Sequence
  Synthetic
  misc_feature (20)..(21): 2'-O-methyl
gaacgauagcuaggaucauuu

SEQ ID NO: 3288 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augguccaucagcuuucuatt

SEQ ID NO: 3289 - RNA, 21 nt, Artificial Sequence
  Synthetic
  misc_feature (20)..(21): 2'-O-methyl
uagaaagcugauggaccauuu

SEQ ID NO: 3290 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacucuuguucagcuucutt

SEQ ID NO: 3291 - RNA, 21 nt, Artificial Sequence
  Synthetic
  misc_feature (20)..(21): 2'-O-methyl
agaagcugaacaagaguccuu

SEQ ID NO: 3292 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuaucaugcguucuccuctt

SEQ ID NO: 3293 - RNA, 21 nt, Artificial Sequence
  Synthetic
  misc_feature (20)..(21): 2'-O-methyl
gaggagaacgcaugauagcuu

SEQ ID NO: 3294 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugaccagcucucucuuctt

SEQ ID NO: 3295 - RNA, 21 nt, Artificial Sequence
  Synthetic
  misc_feature (20)..(21): 2'-O-methyl
gaagagagagcuggucagcuu

SEQ ID NO: 3296 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucgugcacaucaggauacctt

SEQ ID NO: 3297 - RNA, 21 nt, Artificial Sequence
  Synthetic
  misc_feature (20)..(21): 2'-O-methyl
gguauccugaugugcacgauu

SEQ ID NO: 3298 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacuucacucuaggaaugatt

SEQ ID NO: 3299 - RNA, 21 nt, Artificial Sequence
  Synthetic
  misc_feature (20)..(21): 2'-O-methyl
ucauuccuagagugaaguauu

SEQ ID NO: 3300 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaaacaugcaguuguaaatt

SEQ ID NO: 3301 - RNA, 21 nt, Artificial Sequence
  Synthetic
  misc_feature (20)..(21): 2'-O-methyl
uuuacaacugcauguuucauu

SEQ ID NO: 3302 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaugccauuacaacucucctt

SEQ ID NO: 3303 - RNA, 21 nt, Artificial Sequence
  Synthetic
  misc_feature (20)..(21): 2'-O-methyl
ggagaguuguaauggcauauu

SEQ ID NO: 3304 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguuaucagaggacuaaautt

SEQ ID NO: 3305 - RNA, 21 nt, Artificial Sequence
  Synthetic
  misc_feature (20)..(21): 2'-O-methyl
auuuaguccucugauaacauu

SEQ ID NO: 3306 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauggaaggucuccuugggtt

SEQ ID NO: 3307 - RNA, 21 nt, Artificial Sequence
  Synthetic
  misc_feature (20)..(21): 2'-O-methyl
cccaaggagaccuuccaucuu

SEQ ID NO: 3308 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauccaaagaguagcugcatt

SEQ ID NO: 3309 - RNA, 21 nt, Artificial Sequence
  Synthetic
  misc_feature (20)..(21): 2'-O-methyl
ugcagcuacucuuuggauguu

SEQ ID NO: 3310 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccgacaccaagaagcagatt

SEQ ID NO: 3311 - RNA, 21 nt, Artificial Sequence
  Synthetic
  misc_feature (20)..(21): 2'-O-methyl
ucugcuucuuggugucggcuu

SEQ ID NO: 3312 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuuggacucucaggaauctt

SEQ ID NO: 3313 - RNA, 21 nt, Artificial Sequence
  Synthetic
  misc_feature (20)..(21): 2'-O-methyl
gauuccugagaguccaaaguu

SEQ ID NO: 3314 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaacaugagauggguggctt

SEQ ID NO: 3315 - RNA, 21 nt, Artificial Sequence
  Synthetic
  misc_feature (20)..(21): 2'-O-methyl
gccacccaucucauguuccuu

SEQ ID NO: 3316 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggcagugcguuuagcuggtt

SEQ ID NO: 3317 - RNA, 21 nt, Artificial Sequence
  Synthetic
  misc_feature (20)..(21): 2'-O-methyl
ccagcuaaacgcacugccauu

SEQ ID NO: 3318 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaagcugcagaagcuauutt

SEQ ID NO: 3319 - RNA, 21 nt, Artificial Sequence
  Synthetic
  misc_feature (20)..(21): 2'-O-methyl
aauagcuucugcagcuuccuu

SEQ ID NO: 3320 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucuaggaaugaaggugugtt

SEQ ID NO: 3321 - RNA, 21 nt, Artificial Sequence
  Synthetic
  misc_feature (20)..(21): 2'-O-methyl
cacaccuucauuccuagaguu

SEQ ID NO: 3322 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guacgagcugcuauguucctt

SEQ ID NO: 3323 - RNA, 21 nt, Artificial Sequence
  Synthetic
  misc_feature (20)..(21): 2'-O-methyl
ggaacauagcagcucguacuu

SEQ ID NO: 3324 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaccauuccauuguuugugtt

SEQ ID NO: 3325 - RNA, 21 nt, Artificial Sequence
  Synthetic
  misc_feature (20)..(21): 2'-O-methyl
cacaaacaauggaaugguauu

SEQ ID NO: 3326 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccacgacuaguucaguugtt

SEQ ID NO: 3327 - RNA, 21 nt, Artificial Sequence
  Synthetic
  misc_feature (20)..(21): 2'-O-methyl
caacugaacuagucguggauu

SEQ ID NO: 3328 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccucagauggugucugcuatt

SEQ ID NO: 3329 - RNA, 21 nt, Artificial Sequence
  Synthetic
  misc_feature (20)..(21): 2'-O-methyl
uagcagacaccaucugagguu

SEQ ID NO: 3330 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucugugaacuugcucaggtt

SEQ ID NO: 3331 - RNA, 21 nt, Artificial Sequence
  Synthetic
  misc_feature (20)..(21): 2'-O-methyl
ccugagcaaguucacagaguu

SEQ ID NO: 3332 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaguuaugguccaucagctt

SEQ ID NO: 3333 - RNA, 21 nt, Artificial Sequence
  Synthetic
  misc_feature (20)..(21): 2'-O-methyl
gcugauggaccauaacugcuu

SEQ ID NO: 3334 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuuacacccaccaucccatt

SEQ ID NO: 3335 - RNA, 21 nt, Artificial Sequence
  Synthetic
  misc_feature (20)..(21): 2'-O-methyl
ugggaugguggguguaagauu

SEQ ID NO: 3336 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgccaggaugauccuagcutt

SEQ ID NO: 3337 - RNA, 21 nt, Artificial Sequence
  Synthetic
  misc_feature (20)..(21): 2'-O-methyl
agcuaggaucauccuggcguu

SEQ ID NO: 3338 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caccugacagauccaaguctt

SEQ ID NO: 3339 - RNA, 21 nt, Artificial Sequence
  Synthetic
  misc_feature (20)..(21): 2'-O-methyl
gacuuggaucugucagguguu

SEQ ID NO: 3340 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaccugugcagcuggaautt

SEQ ID NO: 3341 - RNA, 21 nt, Artificial Sequence
  Synthetic
  misc_feature (20)..(21): 2'-O-methyl
auuccagcugcacaggugauu

SEQ ID NO: 3342 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaugggcugccuccaggutt

SEQ ID NO: 3343 - RNA, 21 nt, Artificial Sequence
  Synthetic
  misc_feature (20)..(21): 2'-O-methyl
accuggaggcagcccauccuu

SEQ ID NO: 3344 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaccggagcccuucacauctt

SEQ ID NO: 3345 - RNA, 21 nt, Artificial Sequence
  Synthetic
  misc_feature (20)..(21): 2'-O-methyl
gaugugaagggcuccgguauu

SEQ ID NO: 3346 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugagacauuagaugagggctt

SEQ ID NO: 3347 - RNA, 21 nt, Artificial Sequence
  Synthetic
  misc_feature (20)..(21): 2'-O-methyl
gcccucaucuaaugucucauu

SEQ ID NO: 3348 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacucuaggaaugaaggugtt

SEQ ID NO: 3349 - RNA, 21 nt, Artificial Sequence
  Synthetic
  misc_feature (20)..(21): 2'-O-methyl
caccuucauuccuagaguguu

SEQ ID NO: 3350 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugaugcugcucaucccactt

SEQ ID NO: 3351 - RNA, 21 nt, Artificial Sequence
  Synthetic
  misc_feature (20)..(21): 2'-O-methyl
gugggaugagcagcaucaauu

SEQ ID NO: 3352 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucucugagugguaaaggctt

SEQ ID NO: 3353 - RNA, 21 nt, Artificial Sequence
  Synthetic
  misc_feature (20)..(21): 2'-O-methyl
gccuuuaccacucagagaauu

SEQ ID NO: 3354 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguuagucacuggcagcaatt

SEQ ID NO: 3355 - RNA, 21 nt, Artificial Sequence
  Synthetic
  misc_feature (20)..(21): 2'-O-methyl
uugcugccagugacuaacauu

SEQ ID NO: 3356 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagaaauaguugaagguutt

SEQ ID NO: 3357 - RNA, 21 nt, Artificial Sequence
  Synthetic
  misc_feature (20)..(21): 2'-O-methyl
aaccuucaacuauuucuucuu

SEQ ID NO: 3358 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuucacucuaggaaugaagtt

SEQ ID NO: 3359 - RNA, 21 nt, Artificial Sequence
  Synthetic
  misc_feature (20)..(21): 2'-O-methyl
cuucauuccuagagugaaguu

SEQ ID NO: 3360 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuggguucagaugauauaatt

SEQ ID NO: 3361 - RNA, 21 nt, Artificial Sequence
  Synthetic
  misc_feature (20)..(21): 2'-O-methyl
uuauaucaucugaacccaguu

SEQ ID NO: 3362 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacaagccacaagauuactt

SEQ ID NO: 3363 - RNA, 21 nt, Artificial Sequence
  Synthetic
  misc_feature (20)..(21): 2'-O-methyl
guaaucuuguggcuuguccuu

SEQ ID NO: 3364 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acccuggugcugacuaucctt

SEQ ID NO: 3365 - RNA, 21 nt, Artificial Sequence
  Synthetic
  misc_feature (20)..(21): 2'-O-methyl
ggauagucagcaccaggguuu

SEQ ID NO: 3366 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugauauuggugcccagggtt

SEQ ID NO: 3367 - RNA, 21 nt, Artificial Sequence
  Synthetic
  misc_feature (20)..(21): 2'-O-methyl
cccugggcaccaauaucaauu

SEQ ID NO: 3368 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accucccaaguccuguaugtt

SEQ ID NO: 3369 - RNA, 21 nt, Artificial Sequence
  Synthetic
  misc_feature (20)..(21): 2'-O-methyl
cauacaggacuugggagguuu

SEQ ID NO: 3370 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaugcaaugacucgagcutt

SEQ ID NO: 3371 - RNA, 21 nt, Artificial Sequence
  Synthetic
  misc_feature (20)..(21): 2'-O-methyl
agcucgagucauugcauacuu

SEQ ID NO: 3372 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaguugugguuaagcucutt

SEQ ID NO: 3373 - RNA, 21 nt, Artificial Sequence
  Synthetic
  misc_feature (20)..(21): 2'-O-methyl
agagcuuaaccacaacugguu

SEQ ID NO: 3374 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augacucgagcucagagggtt

SEQ ID NO: 3375 - RNA, 21 nt, Artificial Sequence
  Synthetic
  misc_feature (20)..(21): 2'-O-methyl
cccucugagcucgagucauuu

SEQ ID NO: 3376 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguuguaaccugcugugatt

SEQ ID NO: 3377 - RNA, 21 nt, Artificial Sequence
  Synthetic
  misc_feature (20)..(21): 2'-O-methyl
ucacagcagguuacaacaauu

SEQ ID NO: 3378 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaagucaacgucuuguuctt

SEQ ID NO: 3379 - RNA, 21 nt, Artificial Sequence
  Synthetic
  misc_feature (20)..(21): 2'-O-methyl
gaacaagacguugacuugguu

SEQ ID NO: 3380 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugugaacuugcucaggacatt

SEQ ID NO: 3381 - RNA, 21 nt, Artificial Sequence
  Synthetic
  misc_feature (20)..(21): 2'-O-methyl
uguccugagcaaguucacauu

SEQ ID NO: 3382 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucagaggacuaaauaccatt

SEQ ID NO: 3383 - RNA, 21 nt, Artificial Sequence
  Synthetic
  misc_feature (20)..(21): 2'-O-methyl
ugguauuuaguccucugauuu

SEQ ID NO: 3384 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguauggguaggguaaauctt

SEQ ID NO: 3385 - RNA, 21 nt, Artificial Sequence
  Synthetic
  misc_feature (20)..(21): 2'-O-methyl
gauuuacccuacccauacauu

SEQ ID NO: 3386 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accauuccauuguuugugctt

SEQ ID NO: 3387 - RNA, 21 nt, Artificial Sequence
  Synthetic
  misc_feature (20)..(21): 2'-O-methyl
gcacaaacaauggaaugguuu

SEQ ID NO: 3388 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauggaguuggacauggctt

SEQ ID NO: 3389 - RNA, 21 nt, Artificial Sequence
  Synthetic
  misc_feature (20)..(21): 2'-O-methyl
gccauguccaacuccaucauu

SEQ ID NO: 3390 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgugagcagggugccauuctt

SEQ ID NO: 3391 - RNA, 21 nt, Artificial Sequence
  Synthetic
  misc_feature (20)..(21): 2'-O-methyl
gaauggcacccugcucacguu

SEQ ID NO: 3392 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaccucauggaugggcugtt

SEQ ID NO: 3393 - RNA, 21 nt, Artificial Sequence
  Synthetic
  misc_feature (20)..(21): 2'-O-methyl
cagcccauccaugagguccuu

SEQ ID NO: 3394 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaugggcugccagaucugtt

SEQ ID NO: 3395 - RNA, 21 nt, Artificial Sequence
  Synthetic
  misc_feature (20)..(21): 2'-O-methyl
cagaucuggcagcccaucauu

SEQ ID NO: 3396 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuguucgugcacaucaggtt

SEQ ID NO: 3397 - RNA, 21 nt, Artificial Sequence
  Synthetic
  misc_feature (20)..(21): 2'-O-methyl
ccugaugugcacgaacaaguu

SEQ ID NO: 3398 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaucacagaugcugaaactt

SEQ ID NO: 3399 - RNA, 21 nt, Artificial Sequence
  Synthetic
  misc_feature (20)..(21): 2'-O-methyl
guuucagcaucugugaugguu

SEQ ID NO: 3400 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaguuuaccaguugccuutt

SEQ ID NO: 3401 - RNA, 21 nt, Artificial Sequence
  Synthetic
  misc_feature (20)..(21): 2'-O-methyl
aaggcaacugguaaacuguuu

SEQ ID NO: 3402 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accgaauuguuaucagaggtt

SEQ ID NO: 3403 - RNA, 21 nt, Artificial Sequence
  Synthetic
  misc_feature (20)..(21): 2'-O-methyl
ccucugauaacaauucgguuu

SEQ ID NO: 3404 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcagugcguuuagcuggugtt

SEQ ID NO: 3405 - RNA, 21 nt, Artificial Sequence
  Synthetic
  misc_feature (20)..(21): 2'-O-methyl
caccagcuaaacgcacugcuu

SEQ ID NO: 3406 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacaugagauggguggccatt

SEQ ID NO: 3407 - RNA, 21 nt, Artificial Sequence
  Synthetic
  misc_feature (20)..(21): 2'-O-methyl
uggccacccaucucauguuuu

SEQ ID NO: 3408 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccugacagauccaagucaatt

SEQ ID NO: 3409 - RNA, 21 nt, Artificial Sequence
  Synthetic
  misc_feature (20)..(21): 2'-O-methyl
uugacuuggaucugucagguu

SEQ ID NO: 3410 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggauguucacaaccgaautt

SEQ ID NO: 3411 - RNA, 21 nt, Artificial Sequence
  Synthetic
  misc_feature (20)..(21): 2'-O-methyl
auucgguugugaacaucccuu

SEQ ID NO: 3412 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuuaguaaauauaaugagtt

SEQ ID NO: 3413 - RNA, 21 nt, Artificial Sequence
  Synthetic
  misc_feature (20)..(21): 2'-O-methyl
cucauuauauuuacuaaaguu

SEQ ID NO: 3414 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agccugccaucugugcucutt

SEQ ID NO: 3415 - RNA, 21 nt, Artificial Sequence
  Synthetic
  misc_feature (20)..(21): 2'-O-methyl
agagcacagauggcaggcuuu

SEQ ID NO: 3416 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggauugauucgaaaucuugtt

SEQ ID NO: 3417 - RNA, 21 nt, Artificial Sequence
  Synthetic
  misc_feature (20)..(21): 2'-O-methyl
caagauuucgaaucaauccuu

SEQ ID NO: 3418 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagcugcagaagcuauugtt

SEQ ID NO: 3419 - RNA, 21 nt, Artificial Sequence
  Synthetic
  misc_feature (20)..(21): 2'-O-methyl
caauagcuucugcagcuucuu

SEQ ID NO: 3420 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaugacucgagcucagaggtt

SEQ ID NO: 3421 - RNA, 21 nt, Artificial Sequence
  Synthetic
  misc_feature (20)..(21): 2'-O-methyl
ccucugagcucgagucauuuu

SEQ ID NO: 3422 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguucagcuucuggguuctt

SEQ ID NO: 3423 - RNA, 21 nt, Artificial Sequence
  Synthetic
  misc_feature (20)..(21): 2'-O-methyl
gaacccagaagcugaacaauu

SEQ ID NO: 3424 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccucacuugcaauaauuautt

SEQ ID NO: 3425 - RNA, 21 nt, Artificial Sequence
  Synthetic
  misc_feature (20)..(21): 2'-O-methyl
auaauuauugcaagugagguu

SEQ ID NO: 3426 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagauggugucugcuauugtt

SEQ ID NO: 3427 - RNA, 21 nt, Artificial Sequence
  Synthetic
  misc_feature (20)..(21): 2'-O-methyl
caauagcagacaccaucuguu

SEQ ID NO: 3428 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuucacucaagaacaaguatt

SEQ ID NO: 3429 - RNA, 21 nt, Artificial Sequence
  Synthetic
  misc_feature (20)..(21): 2'-O-methyl
uacuuguucuugagugaaguu

SEQ ID NO: 3430 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucacagaugcugaaacautt

SEQ ID NO: 3431 - RNA, 21 nt, Artificial Sequence
  Synthetic
  misc_feature (20)..(21): 2'-O-methyl
auguuucagcaucugugauuu

SEQ ID NO: 3432 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguucgccuucacuauggatt

SEQ ID NO: 3433 - RNA, 21 nt, Artificial Sequence
  Synthetic
  misc_feature (20)..(21): 2'-O-methyl
uccauagugaaggcgaacuuu

SEQ ID NO: 3434 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacuggccaucuuuaaguctt

SEQ ID NO: 3435 - RNA, 21 nt, Artificial Sequence
  Synthetic
  misc_feature (20)..(21): 2'-O-methyl
gacuuaaagauggccaguauu

SEQ ID NO: 3436 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagcuuuaguaaauauaatt

SEQ ID NO: 3437 - RNA, 21 nt, Artificial Sequence
  Synthetic
  misc_feature (20)..(21): 2'-O-methyl
uuauauuuacuaaagcuuguu

SEQ ID NO: 3438 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaagauuacaagaaacggtt

SEQ ID NO: 3439 - RNA, 21 nt, Artificial Sequence
  Synthetic
  misc_feature (20)..(21): 2'-O-methyl
ccguuucuuguaaucuuguuu

SEQ ID NO: 3440 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agccacaagauuacaagaatt

SEQ ID NO: 3441 - RNA, 21 nt, Artificial Sequence
  Synthetic
  misc_feature (20)..(21): 2'-O-methyl
uucuuguaaucuuguggcuuu

SEQ ID NO: 3442 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcagagauggcccagaatt

SEQ ID NO: 3443 - RNA, 21 nt, Artificial Sequence
  Synthetic
  misc_feature (20)..(21): 2'-O-methyl
uucugggccaucucugcuuuu

SEQ ID NO: 3444 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugcagaacuugccacactt

SEQ ID NO: 3445 - RNA, 21 nt, Artificial Sequence
  Synthetic
  misc_feature (20)..(21): 2'-O-methyl
guguggcaaguucugcaucuu

SEQ ID NO: 3446 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucuuucagaugcugcaactt

SEQ ID NO: 3447 - RNA, 21 nt, Artificial Sequence
  Synthetic
  misc_feature (20)..(21): 2'-O-methyl
guugcagcaucugaaagauuu

SEQ ID NO: 3448 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugggacacagcagcaauuutt

SEQ ID NO: 3449 - RNA, 21 nt, Artificial Sequence
  Synthetic
  misc_feature (20)..(21): 2'-O-methyl
aaauugcugcugugucccauu

SEQ ID NO: 3450 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acagauccaagucaacguctt

SEQ ID NO: 3451 - RNA, 21 nt, Artificial Sequence
  Synthetic
  misc_feature (20)..(21): 2'-O-methyl
gacguugacuuggaucuguuu

SEQ ID NO: 3452 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acagcagcaauuuguggagtt

SEQ ID NO: 3453 - RNA, 21 nt, Artificial Sequence
  Synthetic
  misc_feature (20)..(21): 2'-O-methyl
cuccacaaauugcugcuguuu

SEQ ID NO: 3454 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcaacuaaacaggaagggtt

SEQ ID NO: 3455 - RNA, 21 nt, Artificial Sequence
  Synthetic
  misc_feature (20)..(21): 2'-O-methyl
cccuuccuguuuaguugcauu

SEQ ID NO: 3456 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucaggacaaggaagcugtt

SEQ ID NO: 3457 - RNA, 21 nt, Artificial Sequence
  Synthetic
  misc_feature (20)..(21): 2'-O-methyl
cagcuuccuuguccugagcuu

SEQ ID NO: 3458 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaggaugccuuggguaugtt

SEQ ID NO: 3459 - RNA, 21 nt, Artificial Sequence
  Synthetic
  misc_feature (20)..(21): 2'-O-methyl
cauacccaaggcauccugguu

SEQ ID NO: 3460 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuggauugauucgaaaucutt

SEQ ID NO: 3461 - RNA, 21 nt, Artificial Sequence
  Synthetic
  misc_feature (20)..(21): 2'-O-methyl
agauuucgaaucaauccaauu

SEQ ID NO: 3462 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugagugguaaaggcaautt

SEQ ID NO: 3463 - RNA, 21 nt, Artificial Sequence
  Synthetic
  misc_feature (20)..(21): 2'-O-methyl
auugccuuuaccacucagauu

SEQ ID NO: 3464 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaguggauucuguguugutt

SEQ ID NO: 3465 - RNA, 21 nt, Artificial Sequence
  Synthetic
  misc_feature (20)..(21): 2'-O-methyl
acaacacagaauccacugguu

SEQ ID NO: 3466 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuacaucaagaaggagcutt

SEQ ID NO: 3467 - RNA, 21 nt, Artificial Sequence
  Synthetic
  misc_feature (20)..(21): 2'-O-methyl
agcuccuucuugauguaauuu

SEQ ID NO: 3468 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccacaagauuacaagaaactt

SEQ ID NO: 3469 - RNA, 21 nt, Artificial Sequence
  Synthetic
  misc_feature (20)..(21): 2'-O-methyl
guuucuuguaaucuugugguu

SEQ ID NO: 3470 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguaaauauaaugaggacctt

SEQ ID NO: 3471 - RNA, 21 nt, Artificial Sequence
  Synthetic
  misc_feature (20)..(21): 2'-O-methyl
gguccucauuauauuuacuuu

SEQ ID NO: 3472 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacuaaauaccauuccauutt

SEQ ID NO: 3473 - RNA, 21 nt, Artificial Sequence
  Synthetic
  misc_feature (20)..(21): 2'-O-methyl
aauggaaugguauuuagucuu

SEQ ID NO: 3474 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuugaugcugcucaucccatt

SEQ ID NO: 3475 - RNA, 21 nt, Artificial Sequence
  Synthetic
  misc_feature (20)..(21): 2'-O-methyl
ugggaugagcagcaucaaauu

SEQ ID NO: 3476 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggcagcaacagucuuacctt

SEQ ID NO: 3477 - RNA, 21 nt, Artificial Sequence
  Synthetic
  misc_feature (20)..(21): 2'-O-methyl
gguaagacuguugcugccauu

SEQ ID NO: 3478 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagaaagcaagcucaucautt

SEQ ID NO: 3479 - RNA, 21 nt, Artificial Sequence
  Synthetic
  misc_feature (20)..(21): 2'-O-methyl
augaugagcuugcuuucuuuu

SEQ ID NO: 3480 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaucuuggacuugauauutt

SEQ ID NO: 3481 - RNA, 21 nt, Artificial Sequence
  Synthetic
  misc_feature (20)..(21): 2'-O-methyl
aauaucaaguccaagaucauu

SEQ ID NO: 3482 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugaauaaaguguaacaautt

SEQ ID NO: 3483 - RNA, 21 nt, Artificial Sequence
  Synthetic
  misc_feature (20)..(21): 2'-O-methyl
auuguuacacuuuauucaguu

SEQ ID NO: 3484 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuaaauaccauuccauugtt

SEQ ID NO: 3485 - RNA, 21 nt, Artificial Sequence
  Synthetic
  misc_feature (20)..(21): 2'-O-methyl
caauggaaugguauuuaguuu

SEQ ID NO: 3486 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucccacuaauguccagcgtt

SEQ ID NO: 3487 - RNA, 21 nt, Artificial Sequence
  Synthetic
  misc_feature (20)..(21): 2'-O-methyl
cgcuggacauuagugggauuu

SEQ ID NO: 3488 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccacuaccacagcuccuuctt

SEQ ID NO: 3489 - RNA, 21 nt, Artificial Sequence
  Synthetic
  misc_feature (20)..(21): 2'-O-methyl
gaaggagcugugguagugguu

SEQ ID NO: 3490 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caucaggauacccagcgcctt

SEQ ID NO: 3491 - RNA, 21 nt, Artificial Sequence
  Synthetic
  misc_feature (20)..(21): 2'-O-methyl
ggcgcuggguauccugauguu

SEQ ID NO: 3492 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacuguuggauugauucgatt

SEQ ID NO: 3493 - RNA, 21 nt, Artificial Sequence
  Synthetic
  misc_feature (20)..(21): 2'-O-methyl
ucgaaucaauccaacaguauu

SEQ ID NO: 3494 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucacagaugcugaaacaugtt

SEQ ID NO: 3495 - RNA, 21 nt, Artificial Sequence
  Synthetic
  misc_feature (20)..(21): 2'-O-methyl
cauguuucagcaucugugauu

SEQ ID NO: 3496 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuugcgugagcagggugcctt

SEQ ID NO: 3497 - RNA, 21 nt, Artificial Sequence
  Synthetic
  misc_feature (20)..(21): 2'-O-methyl
ggcacccugcucacgcaaauu

SEQ ID NO: 3498 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugaucuuggacuugauatt

SEQ ID NO: 3499 - RNA, 21 nt, Artificial Sequence
  Synthetic
  misc_feature (20)..(21): 2'-O-methyl
uaucaaguccaagaucagcuu

SEQ ID NO: 3500 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguuggauugauucgaaautt

SEQ ID NO: 3501 - RNA, 21 nt, Artificial Sequence
  Synthetic
  misc_feature (20)..(21): 2'-O-methyl
auuucgaaucaauccaacauu

SEQ ID NO: 3502 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcuauuacgacagacugctt

SEQ ID NO: 3503 - RNA, 21 nt, Artificial Sequence
  Synthetic
  misc_feature (20)..(21): 2'-O-methyl
gcagucugucguaauagccuu

SEQ ID NO: 3504 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguggauucuguguuguuutt

SEQ ID NO: 3505 - RNA, 21 nt, Artificial Sequence
  Synthetic
  misc_feature (20)..(21): 2'-O-methyl
aaacaacacagaauccacuuu

SEQ ID NO: 3506 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacagaugcugaaacaugctt

SEQ ID NO: 3507 - RNA, 21 nt, Artificial Sequence
  Synthetic
  misc_feature (20)..(21): 2'-O-methyl
gcauguuucagcaucuguguu

SEQ ID NO: 3508 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacauggccauggaaccatt

SEQ ID NO: 3509 - RNA, 21 nt, Artificial Sequence
  Synthetic
  misc_feature (20)..(21): 2'-O-methyl
ugguuccauggccauguccuu

SEQ ID NO: 3510 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacaagaugauggucugcctt

SEQ ID NO: 3511 - RNA, 21 nt, Artificial Sequence
  Synthetic
  misc_feature (20)..(21): 2'-O-methyl
ggcagaccaucaucuuguuuu

SEQ ID NO: 3512 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuacaucaagaaggagcuatt

SEQ ID NO: 3513 - RNA, 21 nt, Artificial Sequence
  Synthetic
  misc_feature (20)..(21): 2'-O-methyl
uagcuccuucuugauguaauu

SEQ ID NO: 3514 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaucaugcaccuuugcgugtt

SEQ ID NO: 3515 - RNA, 21 nt, Artificial Sequence
  Synthetic
  misc_feature (20)..(21): 2'-O-methyl
cacgcaaaggugcaugauuuu

SEQ ID NO: 3516 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaaaucaugcaccuuugctt

SEQ ID NO: 3517 - RNA, 21 nt, Artificial Sequence
  Synthetic
  misc_feature (20)..(21): 2'-O-methyl
gcaaaggugcaugauuugcuu

SEQ ID NO: 3518 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accucauggaugggcugcctt

SEQ ID NO: 3519 - RNA, 21 nt, Artificial Sequence
  Synthetic
  misc_feature (20)..(21): 2'-O-methyl
ggcagcccauccaugagguuu

SEQ ID NO: 3520 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagugguaaaggcaauccutt

SEQ ID NO: 3521 - RNA, 21 nt, Artificial Sequence
  Synthetic
  misc_feature (20)..(21): 2'-O-methyl
aggauugccuuuaccacucuu

SEQ ID NO: 3522 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucgccuucacuauggacuatt

SEQ ID NO: 3523 - RNA, 21 nt, Artificial Sequence
  Synthetic
  misc_feature (20)..(21): 2'-O-methyl
uaguccauagugaaggcgauu

SEQ ID NO: 3524 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccauucuggugccacuatt

SEQ ID NO: 3525 - RNA, 21 nt, Artificial Sequence
  Synthetic
  misc_feature (20)..(21): 2'-O-methyl
uaguggcaccagaauggauuu

SEQ ID NO: 3526 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucaggauacccagcgccgtt

SEQ ID NO: 3527 - RNA, 21 nt, Artificial Sequence
  Synthetic
  misc_feature (20)..(21): 2'-O-methyl
cggcgcuggguauccugauuu

SEQ ID NO: 3528 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguaugcaaugacucgagctt

SEQ ID NO: 3529 - RNA, 21 nt, Artificial Sequence
  Synthetic
  misc_feature (20)..(21): 2'-O-methyl
gcucgagucauugcauacuuu

SEQ ID NO: 3530 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cggcuuucaguugagcugatt

SEQ ID NO: 3531 - RNA, 21 nt, Artificial Sequence
  Synthetic
  misc_feature (20)..(21): 2'-O-methyl
ucagcucaacugaaagccguu

SEQ ID NO: 3532 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugcaguuaugguccauctt

SEQ ID NO: 3533 - RNA, 21 nt, Artificial Sequence
  Synthetic
  misc_feature (20)..(21): 2'-O-methyl
gauggaccauaacugcagcuu

SEQ ID NO: 3534 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auugaguaaugguguagaatt

SEQ ID NO: 3535 - RNA, 21 nt, Artificial Sequence
  Synthetic
  misc_feature (20)..(21): 2'-O-methyl
uucuacaccauuacucaauuu

SEQ ID NO: 3536 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaaucugaauaaaguguatt

SEQ ID NO: 3537 - RNA, 21 nt, Artificial Sequence
  Synthetic
  misc_feature (20)..(21): 2'-O-methyl
uacacuuuauucagauuacuu

SEQ ID NO: 3538 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugauggacaguaugcaautt

SEQ ID NO: 3539 - RNA, 21 nt, Artificial Sequence
  Synthetic
  misc_feature (20)..(21): 2'-O-methyl
auugcauacuguccaucaauu

SEQ ID NO: 3540 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauauguauggguaggguatt

SEQ ID NO: 3541 - RNA, 21 nt, Artificial Sequence
  Synthetic
  misc_feature (20)..(21): 2'-O-methyl
uacccuacccauacauaucuu

SEQ ID NO: 3542 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaacaagaugauggucugctt

SEQ ID NO: 3543 - RNA, 21 nt, Artificial Sequence
  Synthetic
  misc_feature (20)..(21): 2'-O-methyl
gcagaccaucaucuuguucuu

SEQ ID NO: 3544 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuaucagaggacuaaauactt

SEQ ID NO: 3545 - RNA, 21 nt, Artificial Sequence
  Synthetic
  misc_feature (20)..(21): 2'-O-methyl
guauuuaguccucugauaauu

SEQ ID NO: 3546 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucaccaguggauucugugtt

SEQ ID NO: 3547 - RNA, 21 nt, Artificial Sequence
  Synthetic
  misc_feature (20)..(21): 2'-O-methyl
cacagaauccacuggugaauu

SEQ ID NO: 3548 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagguuguaccggagcccutt

SEQ ID NO: 3549 - RNA, 21 nt, Artificial Sequence
  Synthetic
  misc_feature (20)..(21): 2'-O-methyl
agggcuccgguacaaccuuuu

SEQ ID NO: 3550 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guagaagcugguggaaugctt

SEQ ID NO: 3551 - RNA, 21 nt, Artificial Sequence
  Synthetic
  misc_feature (20)..(21): 2'-O-methyl
gcauuccaccagcuucuacuu

SEQ ID NO: 3552 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcugcaacuaaacaggatt

SEQ ID NO: 3553 - RNA, 21 nt, Artificial Sequence
  Synthetic
  misc_feature (20)..(21): 2'-O-methyl
uccuguuuaguugcagcauuu

SEQ ID NO: 3554 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuggugcugacuauccagutt

SEQ ID NO: 3555 - RNA, 21 nt, Artificial Sequence
  Synthetic
  misc_feature (20)..(21): 2'-O-methyl
acuggauagucagcaccaguu

SEQ ID NO: 3556 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuaugguccaucagcuuutt

SEQ ID NO: 3557 - RNA, 21 nt, Artificial Sequence
  Synthetic
  misc_feature (20)..(21): 2'-O-methyl
aaagcugauggaccauaacuu

SEQ ID NO: 3558 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucacucugguggauauggctt

SEQ ID NO: 3559 - RNA, 21 nt, Artificial Sequence
  Synthetic
  misc_feature (20)..(21): 2'-O-methyl
gccauauccaccagagugauu

SEQ ID NO: 3560 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugauuugauggaguuggatt

SEQ ID NO: 3561 - RNA, 21 nt, Artificial Sequence
  Synthetic
  misc_feature (20)..(21): 2'-O-methyl
uccaacuccaucaaaucaguu

SEQ ID NO: 3562 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaucauacuggcuaguggtt

SEQ ID NO: 3563 - RNA, 21 nt, Artificial Sequence
  Synthetic
  misc_feature (20)..(21): 2'-O-methyl
ccacuagccaguaugaugauu

SEQ ID NO: 3564 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuuguucgugcacaucagtt

SEQ ID NO: 3565 - RNA, 21 nt, Artificial Sequence
  Synthetic
  misc_feature (20)..(21): 2'-O-methyl
cugaugugcacgaacaagcuu

SEQ ID NO: 3566 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugcucuaguaauaagcctt

SEQ ID NO: 3567 - RNA, 21 nt, Artificial Sequence
  Synthetic
  misc_feature (20)..(21): 2'-O-methyl
ggcuuauuacuagagcagauu

SEQ ID NO: 3568 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuggauaucgccaggaugatt

SEQ ID NO: 3569 - RNA, 21 nt, Artificial Sequence
  Synthetic
  misc_feature (20)..(21): 2'-O-methyl
ucauccuggcgauauccaauu

SEQ ID NO: 3570 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaucugucugcucuaguaatt

SEQ ID NO: 3571 - RNA, 21 nt, Artificial Sequence
  Synthetic
  misc_feature (20)..(21): 2'-O-methyl
uuacuagagcagacagauauu

SEQ ID NO: 3572 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaagcucaucauacuggctt

SEQ ID NO: 3573 - RNA, 21 nt, Artificial Sequence
  Synthetic
  misc_feature (20)..(21): 2'-O-methyl
gccaguaugaugagcuugcuu

SEQ ID NO: 3574 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaggguacgagcugcuautt

SEQ ID NO: 3575 - RNA, 21 nt, Artificial Sequence
  Synthetic
  misc_feature (20)..(21): 2'-O-methyl
auagcagcucguacccucuuu

SEQ ID NO: 3576 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugugcguacuguccuucggtt

SEQ ID NO: 3577 - RNA, 21 nt, Artificial Sequence
  Synthetic
  misc_feature (20)..(21): 2'-O-methyl
ccgaaggacaguacgcacauu

SEQ ID NO: 3578 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaagggauggaaggucuctt

SEQ ID NO: 3579 - RNA, 21 nt, Artificial Sequence
  Synthetic
  misc_feature (20)..(21): 2'-O-methyl
gagaccuuccaucccuuccuu

SEQ ID NO: 3580 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacuugcucaggacaaggatt

SEQ ID NO: 3581 - RNA, 21 nt, Artificial Sequence
  Synthetic
  misc_feature (20)..(21): 2'-O-methyl
uccuuguccugagcaaguuuu

SEQ ID NO: 3582 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcguucuccucagauggtt

SEQ ID NO: 3583 - RNA, 21 nt, Artificial Sequence
  Synthetic
  misc_feature (20)..(21): 2'-O-methyl
ccaucugaggagaacgcauuu

SEQ ID NO: 3584 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacagaguuacuucacucutt

SEQ ID NO: 3585 - RNA, 21 nt, Artificial Sequence
  Synthetic
  misc_feature (20)..(21): 2'-O-methyl
agagugaaguaacucugucuu

SEQ ID NO: 3586 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuggcuauuacgacagacutt

SEQ ID NO: 3587 - RNA, 21 nt, Artificial Sequence
  Synthetic
  misc_feature (20)..(21): 2'-O-methyl
agucugucguaauagccaauu

SEQ ID NO: 3588 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacuaccaguugugguuatt

SEQ ID NO: 3589 - RNA, 21 nt, Artificial Sequence
  Synthetic
  misc_feature (20)..(21): 2'-O-methyl
uaaccacaacugguaguccuu

SEQ ID NO: 3590 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucagaacugucuuuggactt

SEQ ID NO: 3591 - RNA, 21 nt, Artificial Sequence
  Synthetic
  misc_feature (20)..(21): 2'-O-methyl
guccaaagacaguucugaauu

SEQ ID NO: 3592 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucugaccagccgacaccatt

SEQ ID NO: 3593 - RNA, 21 nt, Artificial Sequence
  Synthetic
  misc_feature (20)..(21): 2'-O-methyl
uggugucggcuggucagauuu

SEQ ID NO: 3594 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acacagcagcaauuuguggtt

SEQ ID NO: 3595 - RNA, 21 nt, Artificial Sequence
  Synthetic
  misc_feature (20)..(21): 2'-O-methyl
ccacaaauugcugcuguguuu

SEQ ID NO: 3596 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaccacagcuccuucucugtt

SEQ ID NO: 3597 - RNA, 21 nt, Artificial Sequence
  Synthetic
  misc_feature (20)..(21): 2'-O-methyl
cagagaaggagcugugguauu

SEQ ID NO: 3598 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cguccaugggugggacacatt

SEQ ID NO: 3599 - RNA, 21 nt, Artificial Sequence
  Synthetic
  misc_feature (20)..(21): 2'-O-methyl
ugugucccacccauggacguu

SEQ ID NO: 3600 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugugguuaagcucuuacactt

SEQ ID NO: 3601 - RNA, 21 nt, Artificial Sequence
  Synthetic
  misc_feature (20)..(21): 2'-O-methyl
guguaagagcuuaaccacauu

SEQ ID NO: 3602 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguacguaccaugcagaatt

SEQ ID NO: 3603 - RNA, 21 nt, Artificial Sequence
  Synthetic
  misc_feature (20)..(21): 2'-O-methyl
uucugcaugguacguacaauu

SEQ ID NO: 3604 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauacccagcgccguacgutt

SEQ ID NO: 3605 - RNA, 21 nt, Artificial Sequence
  Synthetic
  misc_feature (20)..(21): 2'-O-methyl
acguacggcgcuggguaucuu

SEQ ID NO: 3606 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaugcguucuccucagautt

SEQ ID NO: 3607 - RNA, 21 nt, Artificial Sequence
  Synthetic
  misc_feature (20)..(21): 2'-O-methyl
aucugaggagaacgcaugauu

SEQ ID NO: 3608 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcacaucaggauacccagctt

SEQ ID NO: 3609 - RNA, 21 nt, Artificial Sequence
  Synthetic
  misc_feature (20)..(21): 2'-O-methyl
gcuggguauccugaugugcuu

SEQ ID NO: 3610 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauuacaagaaacggcuuutt

SEQ ID NO: 3611 - RNA, 21 nt, Artificial Sequence
  Synthetic
  misc_feature (20)..(21): 2'-O-methyl
aaagccguuucuuguaaucuu

SEQ ID NO: 3612 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuaccaguugugguuaagtt

SEQ ID NO: 3613 - RNA, 21 nt, Artificial Sequence
  Synthetic
  misc_feature (20)..(21): 2'-O-methyl
cuuaaccacaacugguaguuu

SEQ ID NO: 3614 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucuuguucagaacugucutt

SEQ ID NO: 3615 - RNA, 21 nt, Artificial Sequence
  Synthetic
  misc_feature (20)..(21): 2'-O-methyl
agacaguucugaacaagacuu

SEQ ID NO: 3616 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaucugaccagccgacactt

SEQ ID NO: 3617 - RNA, 21 nt, Artificial Sequence
  Synthetic
  misc_feature (20)..(21): 2'-O-methyl
gugucggcuggucagaugauu

SEQ ID NO: 3618 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuugcgugagcagggugctt

SEQ ID NO: 3619 - RNA, 21 nt, Artificial Sequence
  Synthetic
  misc_feature (20)..(21): 2'-O-methyl
gcacccugcucacgcaaaguu

SEQ ID NO: 3620 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugucuuuggacucucaggtt

SEQ ID NO: 3621 - RNA, 21 nt, Artificial Sequence
  Synthetic
  misc_feature (20)..(21): 2'-O-methyl
ccugagaguccaaagacaguu

SEQ ID NO: 3622 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacaucaagaaggagcuaatt

SEQ ID NO: 3623 - RNA, 21 nt, Artificial Sequence
  Synthetic
  misc_feature (20)..(21): 2'-O-methyl
uuagcuccuucuugauguauu

SEQ ID NO: 3624 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agauccaagucaacgucuutt

SEQ ID NO: 3625 - RNA, 21 nt, Artificial Sequence
  Synthetic
  misc_feature (20)..(21): 2'-O-methyl
aagacguugacuuggaucuuu

SEQ ID NO: 3626 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagucaacgucuuguucatt

SEQ ID NO: 3627 - RNA, 21 nt, Artificial Sequence
  Synthetic
  misc_feature (20)..(21): 2'-O-methyl
ugaacaagacguugacuuguu

SEQ ID NO: 3628 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccuugggacucuuguucatt

SEQ ID NO: 3629 - RNA, 21 nt, Artificial Sequence
  Synthetic
  misc_feature (20)..(21): 2'-O-methyl
ugaacaagagucccaaggauu

SEQ ID NO: 3630 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguggaaugcaagcuuuagtt

SEQ ID NO: 3631 - RNA, 21 nt, Artificial Sequence
  Synthetic
  misc_feature (20)..(21): 2'-O-methyl
cuaaagcuugcauuccaccuu

SEQ ID NO: 3632 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcaacuaaacaggaaggtt

SEQ ID NO: 3633 - RNA, 21 nt, Artificial Sequence
  Synthetic
  misc_feature (20)..(21): 2'-O-methyl
ccuuccuguuuaguugcaguu

SEQ ID NO: 3634 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuaggacuucaccugacagtt

SEQ ID NO: 3635 - RNA, 21 nt, Artificial Sequence
  Synthetic
  misc_feature (20)..(21): 2'-O-methyl
cugucaggugaaguccuaauu

SEQ ID NO: 3636 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguagcugauauugauggatt

SEQ ID NO: 3637 - RNA, 21 nt, Artificial Sequence
  Synthetic
  misc_feature (20)..(21): 2'-O-methyl
uccaucaauaucagcuacuuu

SEQ ID NO: 3638 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauaaugaggaccuauacutt

SEQ ID NO: 3639 - RNA, 21 nt, Artificial Sequence
  Synthetic
  misc_feature (20)..(21): 2'-O-methyl
aguauagguccucauuauauu

SEQ ID NO: 3640 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccugcugugauacgaugcutt

SEQ ID NO: 3641 - RNA, 21 nt, Artificial Sequence
  Synthetic
  misc_feature (20)..(21): 2'-O-methyl
agcaucguaucacagcagguu

SEQ ID NO: 3642 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggguggccaccacccugtt

SEQ ID NO: 3643 - RNA, 21 nt, Artificial Sequence
  Synthetic
  misc_feature (20)..(21): 2'-O-methyl
cagggugguggccacccauuu

SEQ ID NO: 3644 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacucucaggaaucuuucatt

SEQ ID NO: 3645 - RNA, 21 nt, Artificial Sequence
  Synthetic
  misc_feature (20)..(21): 2'-O-methyl
ugaaagauuccugagagucuu

SEQ ID NO: 3646 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcacaucaggauacccatt

SEQ ID NO: 3647 - RNA, 21 nt, Artificial Sequence
  Synthetic
  misc_feature (20)..(21): 2'-O-methyl
uggguauccugaugugcacuu

SEQ ID NO: 3648 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuccagacacgcuaucaugtt

SEQ ID NO: 3649 - RNA, 21 nt, Artificial Sequence
  Synthetic
  misc_feature (20)..(21): 2'-O-methyl
caugauagcgugucuggaauu

SEQ ID NO: 3650 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugccacacgugcaauccctt

SEQ ID NO: 3651 - RNA, 21 nt, Artificial Sequence
  Synthetic
  misc_feature (20)..(21): 2'-O-methyl
gggauugcacguguggcaauu

SEQ ID NO: 3652 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucagaugcugcaacuaaactt

SEQ ID NO: 3653 - RNA, 21 nt, Artificial Sequence
  Synthetic
  misc_feature (20)..(21): 2'-O-methyl
guuuaguugcagcaucugauu

SEQ ID NO: 3654 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuuaggacuucaccugactt

SEQ ID NO: 3655 - RNA, 21 nt, Artificial Sequence
  Synthetic
  misc_feature (20)..(21): 2'-O-methyl
gucaggugaaguccuaaaguu

SEQ ID NO: 3656 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caugcaccuuugcgugagctt

SEQ ID NO: 3657 - RNA, 21 nt, Artificial Sequence
  Synthetic
  misc_feature (20)..(21): 2'-O-methyl
gcucacgcaaaggugcauguu

SEQ ID NO: 3658 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaacucuccacaaccuuutt

SEQ ID NO: 3659 - RNA, 21 nt, Artificial Sequence
  Synthetic
  misc_feature (20)..(21): 2'-O-methyl
aaagguuguggagaguuguuu

SEQ ID NO: 3660 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugggacucuuguucagcuutt

SEQ ID NO: 3661 - RNA, 21 nt, Artificial Sequence
  Synthetic
  misc_feature (20)..(21): 2'-O-methyl
aagcugaacaagagucccauu

SEQ ID NO: 3662 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuugguucaccaguggautt

SEQ ID NO: 3663 - RNA, 21 nt, Artificial Sequence
  Synthetic
  misc_feature (20)..(21): 2'-O-methyl
auccacuggugaaccaagcuu

SEQ ID NO: 3664 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucccaucaucgugagggctt

SEQ ID NO: 3665 - RNA, 21 nt, Artificial Sequence
  Synthetic
  misc_feature (20)..(21): 2'-O-methyl
gcccucacgaugaugggaauu

SEQ ID NO: 3666 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucugcucuaguaauaagctt

SEQ ID NO: 3667 - RNA, 21 nt, Artificial Sequence
  Synthetic
  misc_feature (20)..(21): 2'-O-methyl
gcuuauuacuagagcagacuu

SEQ ID NO: 3668 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagcuucuggguucagaugtt

SEQ ID NO: 3669 - RNA, 21 nt, Artificial Sequence
  Synthetic
  misc_feature (20)..(21): 2'-O-methyl
caucugaacccagaagcuguu

SEQ ID NO: 3670 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgucaucugaccagccgactt

SEQ ID NO: 3671 - RNA, 21 nt, Artificial Sequence
  Synthetic
  misc_feature (20)..(21): 2'-O-methyl
gucggcuggucagaugacguu

SEQ ID NO: 3672 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguucccugagacauuagatt

SEQ ID NO: 3673 - RNA, 21 nt, Artificial Sequence
  Synthetic
  misc_feature (20)..(21): 2'-O-methyl
ucuaaugucucagggaacauu

SEQ ID NO: 3674 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaaccaagaaagcaagcutt

SEQ ID NO: 3675 - RNA, 21 nt, Artificial Sequence
  Synthetic
  misc_feature (20)..(21): 2'-O-methyl
agcuugcuuucuugguugcuu

SEQ ID NO: 3676 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaguuggacauggccaugtt

SEQ ID NO: 3677 - RNA, 21 nt, Artificial Sequence
  Synthetic
  misc_feature (20)..(21): 2'-O-methyl
cauggccauguccaacuccuu

SEQ ID NO: 3678 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guccgcauggaagaaauagtt

SEQ ID NO: 3679 - RNA, 21 nt, Artificial Sequence
  Synthetic
  misc_feature (20)..(21): 2'-O-methyl
cuauuucuuccaugcggacuu

SEQ ID NO: 3680 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugaucuuggacuugauautt

SEQ ID NO: 3681 - RNA, 21 nt, Artificial Sequence
  Synthetic
  misc_feature (20)..(21): 2'-O-methyl
auaucaaguccaagaucaguu

SEQ ID NO: 3682 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggaaggucuccuugggatt

SEQ ID NO: 3683 - RNA, 21 nt, Artificial Sequence
  Synthetic
  misc_feature (20)..(21): 2'-O-methyl
ucccaaggagaccuuccauuu

SEQ ID NO: 3684 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauggucugccaagugggutt

SEQ ID NO: 3685 - RNA, 21 nt, Artificial Sequence
  Synthetic
  misc_feature (20)..(21): 2'-O-methyl
acccacuuggcagaccaucuu

SEQ ID NO: 3686 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgagcucagaggguacgagtt

SEQ ID NO: 3687 - RNA, 21 nt, Artificial Sequence
  Synthetic
  misc_feature (20)..(21): 2'-O-methyl
cucguacccucugagcucguu

SEQ ID NO: 3688 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuaucaagaugaugcagatt

SEQ ID NO: 3689 - RNA, 21 nt, Artificial Sequence
  Synthetic
  misc_feature (20)..(21): 2'-O-methyl
ucugcaucaucuugauaguuu

SEQ ID NO: 3690 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acagaugcugaaacaugcatt

SEQ ID NO: 3691 - RNA, 21 nt, Artificial Sequence
  Synthetic
  misc_feature (20)..(21): 2'-O-methyl
ugcauguuucagcaucuguuu

SEQ ID NO: 3692 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucaguugagcugaccagctt

SEQ ID NO: 3693 - RNA, 21 nt, Artificial Sequence
  Synthetic
  misc_feature (20)..(21): 2'-O-methyl
gcuggucagcucaacugaauu

SEQ ID NO: 3694 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaggcucuugugcguacutt

SEQ ID NO: 3695 - RNA, 21 nt, Artificial Sequence
  Synthetic
  misc_feature (20)..(21): 2'-O-methyl
aguacgcacaagagccucuuu

SEQ ID NO: 3696 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguggauauggccaggaugtt

SEQ ID NO: 3697 - RNA, 21 nt, Artificial Sequence
  Synthetic
  misc_feature (20)..(21): 2'-O-methyl
cauccuggccauauccaccuu

SEQ ID NO: 3698 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuugccacacgugcaaucctt

SEQ ID NO: 3699 - RNA, 21 nt, Artificial Sequence
  Synthetic
  misc_feature (20)..(21): 2'-O-methyl
ggauugcacguguggcaaguu

SEQ ID NO: 3700 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaugcaguucgccuucactt

SEQ ID NO: 3701 - RNA, 21 nt, Artificial Sequence
  Synthetic
  misc_feature (20)..(21): 2'-O-methyl
gugaaggcgaacugcauucuu

SEQ ID NO: 3702 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuagcucgggauguucactt

SEQ ID NO: 3703 - RNA, 21 nt, Artificial Sequence
  Synthetic
  misc_feature (20)..(21): 2'-O-methyl
gugaacaucccgagcuagguu

SEQ ID NO: 3704 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucacuauggacuaccagutt

SEQ ID NO: 3705 - RNA, 21 nt, Artificial Sequence
  Synthetic
  misc_feature (20)..(21): 2'-O-methyl
acugguaguccauagugaauu

SEQ ID NO: 3706 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauggguggccaccacccutt

SEQ ID NO: 3707 - RNA, 21 nt, Artificial Sequence
  Synthetic
  misc_feature (20)..(21): 2'-O-methyl
agggugguggccacccaucuu

SEQ ID NO: 3708 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguuaauaaggcugcagutt

SEQ ID NO: 3709 - RNA, 21 nt, Artificial Sequence
  Synthetic
  misc_feature (20)..(21): 2'-O-methyl
acugcagccuuauuaaccauu

SEQ ID NO: 3710 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucaagaugaugcagaacutt

SEQ ID NO: 3711 - RNA, 21 nt, Artificial Sequence
  Synthetic
  misc_feature (20)..(21): 2'-O-methyl
aguucugcaucaucuugauuu

SEQ ID NO: 3712 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcugugauacgaugcuutt

SEQ ID NO: 3713 - RNA, 21 nt, Artificial Sequence
  Synthetic
  misc_feature (20)..(21): 2'-O-methyl
aagcaucguaucacagcaguu

SEQ ID NO: 3714 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacuugcaauaauuauaagtt

SEQ ID NO: 3715 - RNA, 21 nt, Artificial Sequence
  Synthetic
  misc_feature (20)..(21): 2'-O-methyl
cuuauaauuauugcaaguguu

SEQ ID NO: 3716 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcuacuguuggauugauutt

SEQ ID NO: 3717 - RNA, 21 nt, Artificial Sequence
  Synthetic
  misc_feature (20)..(21): 2'-O-methyl
aaucaauccaacaguagccuu

SEQ ID NO: 3718 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augccuuggguauggaccctt

SEQ ID NO: 3719 - RNA, 21 nt, Artificial Sequence
  Synthetic
  misc_feature (20)..(21): 2'-O-methyl
ggguccauacccaaggcauuu

SEQ ID NO: 3720 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugugauacgaugcuucaagtt

SEQ ID NO: 3721 - RNA, 21 nt, Artificial Sequence
  Synthetic
  misc_feature (20)..(21): 2'-O-methyl
cuugaagcaucguaucacauu

SEQ ID NO: 3722 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagugcugaaggugcuauctt

SEQ ID NO: 3723 - RNA, 21 nt, Artificial Sequence
  Synthetic
  misc_feature (20)..(21): 2'-O-methyl
gauagcaccuucagcacucuu

SEQ ID NO: 3724 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaggguacgagcugcuaugtt

SEQ ID NO: 3725 - RNA, 21 nt, Artificial Sequence
  Synthetic
  misc_feature (20)..(21): 2'-O-methyl
cauagcagcucguacccucuu

SEQ ID NO: 3726 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caucugaccagccgacacctt

SEQ ID NO: 3727 - RNA, 21 nt, Artificial Sequence
  Synthetic
  misc_feature (20)..(21): 2'-O-methyl
ggugucggcuggucagauguu

SEQ ID NO: 3728 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuaauuguaaucugaauaatt

SEQ ID NO: 3729 - RNA, 21 nt, Artificial Sequence
  Synthetic
  misc_feature (20)..(21): 2'-O-methyl
uuauucagauuacaauuaauu

SEQ ID NO: 3730 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caccaagaagcagagauggtt

SEQ ID NO: 3731 - RNA, 21 nt, Artificial Sequence
  Synthetic
  misc_feature (20)..(21): 2'-O-methyl
ccaucucugcuucuugguguu

SEQ ID NO: 3732 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuacuucacucuaggaaugtt

SEQ ID NO: 3733 - RNA, 21 nt, Artificial Sequence
  Synthetic
  misc_feature (20)..(21): 2'-O-methyl
cauuccuagagugaaguaauu

SEQ ID NO: 3734 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcaagcuuuaggacuucatt

SEQ ID NO: 3735 - RNA, 21 nt, Artificial Sequence
  Synthetic
  misc_feature (20)..(21): 2'-O-methyl
ugaaguccuaaagcuugcauu

SEQ ID NO: 3736 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuauguucccugagacautt

SEQ ID NO: 3737 - RNA, 21 nt, Artificial Sequence
  Synthetic
  misc_feature (20)..(21): 2'-O-methyl
augucucagggaacauagcuu

SEQ ID NO: 3738 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaugcaagcuuuaggacutt

SEQ ID NO: 3739 - RNA, 21 nt, Artificial Sequence
  Synthetic
  misc_feature (20)..(21): 2'-O-methyl
aguccuaaagcuugcauucuu

SEQ ID NO: 3740 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accuuugcgugagcagggutt

SEQ ID NO: 3741 - RNA, 21 nt, Artificial Sequence
  Synthetic
  misc_feature (20)..(21): 2'-O-methyl
acccugcucacgcaaagguuu

SEQ ID NO: 3742 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggugcuaucugucugcuctt

SEQ ID NO: 3743 - RNA, 21 nt, Artificial Sequence
  Synthetic
  misc_feature (20)..(21): 2'-O-methyl
gagcagacagauagcaccuuu

SEQ ID NO: 3744 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugcucaggacaaggaagctt

SEQ ID NO: 3745 - RNA, 21 nt, Artificial Sequence
  Synthetic
  misc_feature (20)..(21): 2'-O-methyl
gcuuccuuguccugagcaauu

SEQ ID NO: 3746 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugagggagccacagcuctt

SEQ ID NO: 3747 - RNA, 21 nt, Artificial Sequence
  Synthetic
  misc_feature (20)..(21): 2'-O-methyl
gagcuguggcucccucagcuu

SEQ ID NO: 3748 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaccacagcuccuucucutt

SEQ ID NO: 3749 - RNA, 21 nt, Artificial Sequence
  Synthetic
  misc_feature (20)..(21): 2'-O-methyl
agagaaggagcugugguaguu

SEQ ID NO: 3750 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaacaugagauggguggtt

SEQ ID NO: 3751 - RNA, 21 nt, Artificial Sequence
  Synthetic
  misc_feature (20)..(21): 2'-O-methyl
ccacccaucucauguuccauu

SEQ ID NO: 3752 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuauuguacguaccaugctt

SEQ ID NO: 3753 - RNA, 21 nt, Artificial Sequence
  Synthetic
  misc_feature (20)..(21): 2'-O-methyl
gcaugguacguacaauagcuu

SEQ ID NO: 3754 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuugcccuuugucccgcatt

SEQ ID NO: 3755 - RNA, 21 nt, Artificial Sequence
  Synthetic
  misc_feature (20)..(21): 2'-O-methyl
ugcgggacaaagggcaagauu

SEQ ID NO: 3756 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuauaagaacaagaugaugtt

SEQ ID NO: 3757 - RNA, 21 nt, Artificial Sequence
  Synthetic
  misc_feature (20)..(21): 2'-O-methyl
caucaucuuguucuuauaauu

SEQ ID NO: 3758 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaagcuuccagacacgcutt

SEQ ID NO: 3759 - RNA, 21 nt, Artificial Sequence
  Synthetic
  misc_feature (20)..(21): 2'-O-methyl
agcgugucuggaagcuuccuu

SEQ ID NO: 3760 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaagccggcuauuguagaatt

SEQ ID NO: 3761 - RNA, 21 nt, Artificial Sequence
  Synthetic
  misc_feature (20)..(21): 2'-O-methyl
uucuacaauagccggcuuauu

SEQ ID NO: 3762 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaccagguggugguuaautt

SEQ ID NO: 3763 - RNA, 21 nt, Artificial Sequence
  Synthetic
  misc_feature (20)..(21): 2'-O-methyl
auuaaccaccaccugguccuu

SEQ ID NO: 3764 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugauauugauggacaguatt

SEQ ID NO: 3765 - RNA, 21 nt, Artificial Sequence
  Synthetic
  misc_feature (20)..(21): 2'-O-methyl
uacuguccaucaauaucaguu

SEQ ID NO: 3766 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggguaggguaaaucaguatt

SEQ ID NO: 3767 - RNA, 21 nt, Artificial Sequence
  Synthetic
  misc_feature (20)..(21): 2'-O-methyl
uacugauuuacccuacccauu

SEQ ID NO: 3768 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuugauauuggugcccagtt

SEQ ID NO: 3769 - RNA, 21 nt, Artificial Sequence
  Synthetic
  misc_feature (20)..(21): 2'-O-methyl
cugggcaccaauaucaaguuu

SEQ ID NO: 3770 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaagcucuuacacccaccatt

SEQ ID NO: 3771 - RNA, 21 nt, Artificial Sequence
  Synthetic
  misc_feature (20)..(21): 2'-O-methyl
ugguggguguaagagcuuauu

SEQ ID NO: 3772 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuacucaagcugauuugautt

SEQ ID NO: 3773 - RNA, 21 nt, Artificial Sequence
  Synthetic
  misc_feature (20)..(21): 2'-O-methyl
aucaaaucagcuugaguaguu

SEQ ID NO: 3774 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugccauuccacgacuagtt

SEQ ID NO: 3775 - RNA, 21 nt, Artificial Sequence
  Synthetic
  misc_feature (20)..(21): 2'-O-methyl
cuagucguggaauggcaccuu

SEQ ID NO: 3776 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuggacauggccauggaactt

SEQ ID NO: 3777 - RNA, 21 nt, Artificial Sequence
  Synthetic
  misc_feature (20)..(21): 2'-O-methyl
guuccauggccauguccaauu

SEQ ID NO: 3778 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcucaucccacuaaugutt

SEQ ID NO: 3779 - RNA, 21 nt, Artificial Sequence
  Synthetic
  misc_feature (20)..(21): 2'-O-methyl
acauuagugggaugagcaguu

SEQ ID NO: 3780 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauggccauggaaccagactt

SEQ ID NO: 3781 - RNA, 21 nt, Artificial Sequence
  Synthetic
  misc_feature (20)..(21): 2'-O-methyl
gucugguuccauggccauguu

SEQ ID NO: 3782 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauggcaaccaagaaagcatt

SEQ ID NO: 3783 - RNA, 21 nt, Artificial Sequence
  Synthetic
  misc_feature (20)..(21): 2'-O-methyl
ugcuuucuugguugccauauu

SEQ ID NO: 3784 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accaguggauucuguguugtt

SEQ ID NO: 3785 - RNA, 21 nt, Artificial Sequence
  Synthetic
  misc_feature (20)..(21): 2'-O-methyl
caacacagaauccacugguuu

SEQ ID NO: 3786 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acagaguuacuucacucuatt

SEQ ID NO: 3787 - RNA, 21 nt, Artificial Sequence
  Synthetic
  misc_feature (20)..(21): 2'-O-methyl
uagagugaaguaacucuguuu

SEQ ID NO: 3788 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaggacuucaccugacagatt

SEQ ID NO: 3789 - RNA, 21 nt, Artificial Sequence
  Synthetic
  misc_feature (20)..(21): 2'-O-methyl
ucugucaggugaaguccuauu

SEQ ID NO: 3790 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccaggaugccuuggguautt

SEQ ID NO: 3791 - RNA, 21 nt, Artificial Sequence
  Synthetic
  misc_feature (20)..(21): 2'-O-methyl
auacccaaggcauccuggcuu

SEQ ID NO: 3792 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaugaggaccuauacuuactt

SEQ ID NO: 3793 - RNA, 21 nt, Artificial Sequence
  Synthetic
  misc_feature (20)..(21): 2'-O-methyl
guaaguauagguccucauuuu

SEQ ID NO: 3794 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auucuuggcuauuacgacatt

SEQ ID NO: 3795 - RNA, 21 nt, Artificial Sequence
  Synthetic
  misc_feature (20)..(21): 2'-O-methyl
ugucguaauagccaagaauuu

SEQ ID NO: 3796 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuuauucucccauugaaatt

SEQ ID NO: 3797 - RNA, 21 nt, Artificial Sequence
  Synthetic
  misc_feature (20)..(21): 2'-O-methyl
uuucaaugggagaauaaaguu

SEQ ID NO: 3798 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accagguggugguuaauaatt

SEQ ID NO: 3799 - RNA, 21 nt, Artificial Sequence
  Synthetic
  misc_feature (20)..(21): 2'-O-methyl
uuauuaaccaccaccugguuu

SEQ ID NO: 3800 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accucacuugcaauaauuatt

SEQ ID NO: 3801 - RNA, 21 nt, Artificial Sequence
  Synthetic
  misc_feature (20)..(21): 2'-O-methyl
uaauuauugcaagugagguuu

SEQ ID NO: 3802 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagcugauauugauggacatt

SEQ ID NO: 3803 - RNA, 21 nt, Artificial Sequence
  Synthetic
  misc_feature (20)..(21): 2'-O-methyl
uguccaucaauaucagcuauu

SEQ ID NO: 3804 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaacugucuuuggacucuctt

SEQ ID NO: 3805 - RNA, 21 nt, Artificial Sequence
  Synthetic
  misc_feature (20)..(21): 2'-O-methyl
gagaguccaaagacaguucuu

SEQ ID NO: 3806 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuagucacuggcagcaacatt

SEQ ID NO: 3807 - RNA, 21 nt, Artificial Sequence
  Synthetic
  misc_feature (20)..(21): 2'-O-methyl
uguugcugccagugacuaauu

SEQ ID NO: 3808 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccauuacaacucuccacaatt

SEQ ID NO: 3809 - RNA, 21 nt, Artificial Sequence
  Synthetic
  misc_feature (20)..(21): 2'-O-methyl
uuguggagaguuguaaugguu

SEQ ID NO: 3810 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugguuaagcucuuacacctt

SEQ ID NO: 3811 - RNA, 21 nt, Artificial Sequence
  Synthetic
  misc_feature (20)..(21): 2'-O-methyl
gguguaagagcuuaaccacuu

SEQ ID NO: 3812 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauuugauggaguuggactt

SEQ ID NO: 3813 - RNA, 21 nt, Artificial Sequence
  Synthetic
  misc_feature (20)..(21): 2'-O-methyl
guccaacuccaucaaaucauu

SEQ ID NO: 3814 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcagagauggcccagaaugtt

SEQ ID NO: 3815 - RNA, 21 nt, Artificial Sequence
  Synthetic
  misc_feature (20)..(21): 2'-O-methyl
cauucugggccaucucugcuu

SEQ ID NO: 3816 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuaaacaggaagggauggtt

SEQ ID NO: 3817 - RNA, 21 nt, Artificial Sequence
  Synthetic
  misc_feature (20)..(21): 2'-O-methyl
ccaucccuuccuguuuaguuu

SEQ ID NO: 3818 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaaauguuaaauucuuggtt

SEQ ID NO: 3819 - RNA, 21 nt, Artificial Sequence
  Synthetic
  misc_feature (20)..(21): 2'-O-methyl
ccaagaauuuaacauuuguuu

SEQ ID NO: 3820 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaaugacucgagcucagatt

SEQ ID NO: 3821 - RNA, 21 nt, Artificial Sequence
  Synthetic
  misc_feature (20)..(21): 2'-O-methyl
ucugagcucgagucauugcuu

SEQ ID NO: 3822 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucgggauguucacaaccgtt

SEQ ID NO: 3823 - RNA, 21 nt, Artificial Sequence
  Synthetic
  misc_feature (20)..(21): 2'-O-methyl
cgguugugaacaucccgaguu

SEQ ID NO: 3824 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugucugcuauuguacguatt

SEQ ID NO: 3825 - RNA, 21 nt, Artificial Sequence
  Synthetic
  misc_feature (20)..(21): 2'-O-methyl
uacguacaauagcagacacuu

SEQ ID NO: 3826 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguggauaccucccaaguctt

SEQ ID NO: 3827 - RNA, 21 nt, Artificial Sequence
  Synthetic
  misc_feature (20)..(21): 2'-O-methyl
gacuugggagguauccacauu

SEQ ID NO: 3828 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaggcucuugugcguacugtt

SEQ ID NO: 3829 - RNA, 21 nt, Artificial Sequence
  Synthetic
  misc_feature (20)..(21): 2'-O-methyl
caguacgcacaagagccucuu

SEQ ID NO: 3830 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaugccuuggguauggactt

SEQ ID NO: 3831 - RNA, 21 nt, Artificial Sequence
  Synthetic
  misc_feature (20)..(21): 2'-O-methyl
guccauacccaaggcauccuu

SEQ ID NO: 3832 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaauucuuggcuauuacgatt

SEQ ID NO: 3833 - RNA, 21 nt, Artificial Sequence
  Synthetic
  misc_feature (20)..(21): 2'-O-methyl
ucguaauagccaagaauuuuu

SEQ ID NO: 3834 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacgagcugcuauguuccctt

SEQ ID NO: 3835 - RNA, 21 nt, Artificial Sequence
  Synthetic
  misc_feature (20)..(21): 2'-O-methyl
gggaacauagcagcucguauu

SEQ ID NO: 3836 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagugcguuuagcugguggtt

SEQ ID NO: 3837 - RNA, 21 nt, Artificial Sequence
  Synthetic
  misc_feature (20)..(21): 2'-O-methyl
ccaccagcuaaacgcacuguu

SEQ ID NO: 3838 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagaugaugcagaacuugtt

SEQ ID NO: 3839 - RNA, 21 nt, Artificial Sequence
  Synthetic
  misc_feature (20)..(21): 2'-O-methyl
caaguucugcaucaucuuguu

SEQ ID NO: 3840 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augauguagaaacagcucgtt

SEQ ID NO: 3841 - RNA, 21 nt, Artificial Sequence
  Synthetic
  misc_feature (20)..(21): 2'-O-methyl
cgagcuguuucuacaucauuu

SEQ ID NO: 3842 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcagcugcuuuauucucctt

SEQ ID NO: 3843 - RNA, 21 nt, Artificial Sequence
  Synthetic
  misc_feature (20)..(21): 2'-O-methyl
ggagaauaaagcagcugcauu

SEQ ID NO: 3844 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccacagcuccuucucugagtt

SEQ ID NO: 3845 - RNA, 21 nt, Artificial Sequence
  Synthetic
  misc_feature (20)..(21): 2'-O-methyl
cucagagaaggagcugugguu

SEQ ID NO: 3846 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguucgccuucacuauggtt

SEQ ID NO: 3847 - RNA, 21 nt, Artificial Sequence
  Synthetic
  misc_feature (20)..(21): 2'-O-methyl
ccauagugaaggcgaacuguu

SEQ ID NO: 3848 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcuuccagacacgcuautt

SEQ ID NO: 3849 - RNA, 21 nt, Artificial Sequence
  Synthetic
  misc_feature (20)..(21): 2'-O-methyl
auagcgugucuggaagcuuuu

SEQ ID NO: 3850 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuucaguugagcugaccagtt

SEQ ID NO: 3851 - RNA, 21 nt, Artificial Sequence
  Synthetic
  misc_feature (20)..(21): 2'-O-methyl
cuggucagcucaacugaaauu

SEQ ID NO: 3852 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuggugccacuaccacagtt

SEQ ID NO: 3853 - RNA, 21 nt, Artificial Sequence
  Synthetic
  misc_feature (20)..(21): 2'-O-methyl
cugugguaguggcaccagauu

SEQ ID NO: 3854 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgcuaucaugcguucuccutt

SEQ ID NO: 3855 - RNA, 21 nt, Artificial Sequence
  Synthetic
  misc_feature (20)..(21): 2'-O-methyl
aggagaacgcaugauagcguu

SEQ ID NO: 3856 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacagggaagacaucacugtt

SEQ ID NO: 3857 - RNA, 21 nt, Artificial Sequence
  Synthetic
  misc_feature (20)..(21): 2'-O-methyl
cagugaugucuucccugucuu

SEQ ID NO: 3858 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucauacuggcuaguggugtt

SEQ ID NO: 3859 - RNA, 21 nt, Artificial Sequence
  Synthetic
  misc_feature (20)..(21): 2'-O-methyl
caccacuagccaguaugauuu

SEQ ID NO: 3860 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuggugacagggaagacatt

SEQ ID NO: 3861 - RNA, 21 nt, Artificial Sequence
  Synthetic
  misc_feature (20)..(21): 2'-O-methyl
ugucuucccugucaccagcuu

SEQ ID NO: 3862 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccuagcucgggauguuctt

SEQ ID NO: 3863 - RNA, 21 nt, Artificial Sequence
  Synthetic
  misc_feature (20)..(21): 2'-O-methyl
gaacaucccgagcuaggauuu

SEQ ID NO: 3864 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guccuguaugagugggaactt

SEQ ID NO: 3865 - RNA, 21 nt, Artificial Sequence
  Synthetic
  misc_feature (20)..(21): 2'-O-methyl
guucccacucauacaggacuu

SEQ ID NO: 3866 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcccaggaccucauggaugtt

SEQ ID NO: 3867 - RNA, 21 nt, Artificial Sequence
  Synthetic
  misc_feature (20)..(21): 2'-O-methyl
cauccaugagguccugggcuu

SEQ ID NO: 3868 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugggauauguauggguaggtt

SEQ ID NO: 3869 - RNA, 21 nt, Artificial Sequence
  Synthetic
  misc_feature (20)..(21): 2'-O-methyl
ccuacccauacauaucccauu

SEQ ID NO: 3870 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuggacuugauauuggugtt

SEQ ID NO: 3871 - RNA, 21 nt, Artificial Sequence
  Synthetic
  misc_feature (20)..(21): 2'-O-methyl
caccaauaucaaguccaaguu

SEQ ID NO: 3872 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuuugucccgcaaaucautt

SEQ ID NO: 3873 - RNA, 21 nt, Artificial Sequence
  Synthetic
  misc_feature (20)..(21): 2'-O-methyl
augauuugcgggacaaagguu

SEQ ID NO: 3874 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaaggugcuaucugucugtt

SEQ ID NO: 3875 - RNA, 21 nt, Artificial Sequence
  Synthetic
  misc_feature (20)..(21): 2'-O-methyl
cagacagauagcaccuucauu

SEQ ID NO: 3876 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuucacucaagaacaagutt

SEQ ID NO: 3877 - RNA, 21 nt, Artificial Sequence
  Synthetic
  misc_feature (20)..(21): 2'-O-methyl
acuuguucuugagugaagguu

SEQ ID NO: 3878 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaggucuccuugggacuctt

SEQ ID NO: 3879 - RNA, 21 nt, Artificial Sequence
  Synthetic
  misc_feature (20)..(21): 2'-O-methyl
gagucccaaggagaccuucuu

SEQ ID NO: 3880 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaaacggcuuucaguugatt

SEQ ID NO: 3881 - RNA, 21 nt, Artificial Sequence
  Synthetic
  misc_feature (20)..(21): 2'-O-methyl
ucaacugaaagccguuucuuu

SEQ ID NO: 3882 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acccagcgccguacguccatt

SEQ ID NO: 3883 - RNA, 21 nt, Artificial Sequence
  Synthetic
  misc_feature (20)..(21): 2'-O-methyl
uggacguacggcgcuggguuu

SEQ ID NO: 3884 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauaaccuuucccaucauctt

SEQ ID NO: 3885 - RNA, 21 nt, Artificial Sequence
  Synthetic
  misc_feature (20)..(21): 2'-O-methyl
gaugaugggaaagguuauguu

SEQ ID NO: 3886 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagguuguaccggagccctt

SEQ ID NO: 3887 - RNA, 21 nt, Artificial Sequence
  Synthetic
  misc_feature (20)..(21): 2'-O-methyl
gggcuccgguacaaccuucuu

SEQ ID NO: 3888 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucccgcaaaucaugcacctt

SEQ ID NO: 3889 - RNA, 21 nt, Artificial Sequence
  Synthetic
  misc_feature (20)..(21): 2'-O-methyl
ggugcaugauuugcgggacuu

SEQ ID NO: 3890 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagcucaucauacuggcutt

SEQ ID NO: 3891 - RNA, 21 nt, Artificial Sequence
  Synthetic
  misc_feature (20)..(21): 2'-O-methyl
agccaguaugaugagcuuguu

SEQ ID NO: 3892 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgccguacguccaugggugtt

SEQ ID NO: 3893 - RNA, 21 nt, Artificial Sequence
  Synthetic
  misc_feature (20)..(21): 2'-O-methyl
cacccauggacguacggcguu

SEQ ID NO: 3894 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaguuacuucacucuaggtt

SEQ ID NO: 3895 - RNA, 21 nt, Artificial Sequence
  Synthetic
  misc_feature (20)..(21): 2'-O-methyl
ccuagagugaaguaacucuuu

SEQ ID NO: 3896 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuggacauggccauggaatt

SEQ ID NO: 3897 - RNA, 21 nt, Artificial Sequence
  Synthetic
  misc_feature (20)..(21): 2'-O-methyl
uuccauggccauguccaacuu

SEQ ID NO: 3898 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggcuauuacgacagacugtt

SEQ ID NO: 3899 - RNA, 21 nt, Artificial Sequence
  Synthetic
  misc_feature (20)..(21): 2'-O-methyl
cagucugucguaauagccauu

SEQ ID NO: 3900 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acucgagcucagaggguactt

SEQ ID NO: 3901 - RNA, 21 nt, Artificial Sequence
  Synthetic
  misc_feature (20)..(21): 2'-O-methyl
guacccucugagcucgaguuu

SEQ ID NO: 3902 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaguuugaugcugcucautt

SEQ ID NO: 3903 - RNA, 21 nt, Artificial Sequence
  Synthetic
  misc_feature (20)..(21): 2'-O-methyl
augagcagcaucaaacuguuu

SEQ ID NO: 3904 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugguuaauaaggcugcatt

SEQ ID NO: 3905 - RNA, 21 nt, Artificial Sequence
  Synthetic
  misc_feature (20)..(21): 2'-O-methyl
ugcagccuuauuaaccaccuu

SEQ ID NO: 3906 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuugucccgcaaaucaugtt

SEQ ID NO: 3907 - RNA, 21 nt, Artificial Sequence
  Synthetic
  misc_feature (20)..(21): 2'-O-methyl
caugauuugcgggacaaaguu

SEQ ID NO: 3908 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauaccauuccauuguuugtt

SEQ ID NO: 3909 - RNA, 21 nt, Artificial Sequence
  Synthetic
  misc_feature (20)..(21): 2'-O-methyl
caaacaauggaaugguauuuu

SEQ ID NO: 3910 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccacacgugcaaucccugatt

SEQ ID NO: 3911 - RNA, 21 nt, Artificial Sequence
  Synthetic
  misc_feature (20)..(21): 2'-O-methyl
ucagggauugcacgugugguu

SEQ ID NO: 3912 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggccaggaugccuugggtt

SEQ ID NO: 3913 - RNA, 21 nt, Artificial Sequence
  Synthetic
  misc_feature (20)..(21): 2'-O-methyl
cccaaggcauccuggccauuu

SEQ ID NO: 3914 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggauacccagcgccguacgtt

SEQ ID NO: 3915 - RNA, 21 nt, Artificial Sequence
  Synthetic
  misc_feature (20)..(21): 2'-O-methyl
cguacggcgcuggguauccuu

SEQ ID NO: 3916 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucgccaggaugauccuagctt

SEQ ID NO: 3917 - RNA, 21 nt, Artificial Sequence
  Synthetic
  misc_feature (20)..(21): 2'-O-methyl
gcuaggaucauccuggcgauu

SEQ ID NO: 3918 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguccaucagcuuucuaatt

SEQ ID NO: 3919 - RNA, 21 nt, Artificial Sequence
  Synthetic
  misc_feature (20)..(21): 2'-O-methyl
uuagaaagcugauggaccauu

SEQ ID NO: 3920 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auauguauggguaggguaatt

SEQ ID NO: 3921 - RNA, 21 nt, Artificial Sequence
  Synthetic
  misc_feature (20)..(21): 2'-O-methyl
uuacccuacccauacauauuu

SEQ ID NO: 3922 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccagaaugcaguucgccutt

SEQ ID NO: 3923 - RNA, 21 nt, Artificial Sequence
  Synthetic
  misc_feature (20)..(21): 2'-O-methyl
aggcgaacugcauucuggguu

SEQ ID NO: 3924 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauuguagaagcugguggatt

SEQ ID NO: 3925 - RNA, 21 nt, Artificial Sequence
  Synthetic
  misc_feature (20)..(21): 2'-O-methyl
uccaccagcuucuacaauauu

SEQ ID NO: 3926 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guauggguaggguaaaucatt

SEQ ID NO: 3927 - RNA, 21 nt, Artificial Sequence
  Synthetic
  misc_feature (20)..(21): 2'-O-methyl
ugauuuacccuacccauacuu

SEQ ID NO: 3928 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaucuuggacuugauauugtt

SEQ ID NO: 3929 - RNA, 21 nt, Artificial Sequence
  Synthetic
  misc_feature (20)..(21): 2'-O-methyl
caauaucaaguccaagaucuu

SEQ ID NO: 3930 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acacgugcaaucccugaactt

SEQ ID NO: 3931 - RNA, 21 nt, Artificial Sequence
  Synthetic
  misc_feature (20)..(21): 2'-O-methyl
guucagggauugcacguguuu

SEQ ID NO: 3932 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcgccguacguccaugggtt

SEQ ID NO: 3933 - RNA, 21 nt, Artificial Sequence
  Synthetic
  misc_feature (20)..(21): 2'-O-methyl
cccauggacguacggcgcuuu

SEQ ID NO: 3934 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguaccggagcccuucacatt

SEQ ID NO: 3935 - RNA, 21 nt, Artificial Sequence
  Synthetic
  misc_feature (20)..(21): 2'-O-methyl
ugugaagggcuccgguacauu

SEQ ID NO: 3936 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guugaugggcugccagauctt

SEQ ID NO: 3937 - RNA, 21 nt, Artificial Sequence
  Synthetic
  misc_feature (20)..(21): 2'-O-methyl
gaucuggcagcccaucaacuu

SEQ ID NO: 3938 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acacccaccaucccacuggtt

SEQ ID NO: 3939 - RNA, 21 nt, Artificial Sequence
  Synthetic
  misc_feature (20)..(21): 2'-O-methyl
ccagugggaugguggguguuu

SEQ ID NO: 3940 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacgacagacugccuucaatt

SEQ ID NO: 3941 - RNA, 21 nt, Artificial Sequence
  Synthetic
  misc_feature (20)..(21): 2'-O-methyl
uugaaggcagucugucguauu

SEQ ID NO: 3942 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguucgugcacaucaggatt

SEQ ID NO: 3943 - RNA, 21 nt, Artificial Sequence
  Synthetic
  misc_feature (20)..(21): 2'-O-methyl
uccugaugugcacgaacaauu

SEQ ID NO: 3944 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaaucaugcaccuuugcgtt

SEQ ID NO: 3945 - RNA, 21 nt, Artificial Sequence
  Synthetic
  misc_feature (20)..(21): 2'-O-methyl
cgcaaaggugcaugauuuguu

SEQ ID NO: 3946 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucuggaggcauuccugcctt

SEQ ID NO: 3947 - RNA, 21 nt, Artificial Sequence
  Synthetic
  misc_feature (20)..(21): 2'-O-methyl
ggcaggaaugccuccagacuu

SEQ ID NO: 3948 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacuauggacuaccaguugtt

SEQ ID NO: 3949 - RNA, 21 nt, Artificial Sequence
  Synthetic
  misc_feature (20)..(21): 2'-O-methyl
caacugguaguccauaguguu

SEQ ID NO: 3950 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaucaugcguucuccucagtt

SEQ ID NO: 3951 - RNA, 21 nt, Artificial Sequence
  Synthetic
  misc_feature (20)..(21): 2'-O-methyl
cugaggagaacgcaugauauu

SEQ ID NO: 3952 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guagaaacagcucguuguatt

SEQ ID NO: 3953 - RNA, 21 nt, Artificial Sequence
  Synthetic
  misc_feature (20)..(21): 2'-O-methyl
uacaacgagcuguuucuacuu

SEQ ID NO: 3954 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuccucugacagaguuacutt

SEQ ID NO: 3955 - RNA, 21 nt, Artificial Sequence
  Synthetic
  misc_feature (20)..(21): 2'-O-methyl
aguaacucugucagaggaguu

SEQ ID NO: 3956 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcucaggacaaggaagcutt

SEQ ID NO: 3957 - RNA, 21 nt, Artificial Sequence
  Synthetic
  misc_feature (20)..(21): 2'-O-methyl
agcuuccuuguccugagcauu

SEQ ID NO: 3958 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagugggugguauagaggtt

SEQ ID NO: 3959 - RNA, 21 nt, Artificial Sequence
  Synthetic
  misc_feature (20)..(21): 2'-O-methyl
ccucuauaccacccacuuguu

SEQ ID NO: 3960 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggugguuaauaaggcugctt

SEQ ID NO: 3961 - RNA, 21 nt, Artificial Sequence
  Synthetic
  misc_feature (20)..(21): 2'-O-methyl
gcagccuuauuaaccaccauu

SEQ ID NO: 3962 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuucaccugacagauccatt

SEQ ID NO: 3963 - RNA, 21 nt, Artificial Sequence
  Synthetic
  misc_feature (20)..(21): 2'-O-methyl
uggaucugucaggugaaguuu

SEQ ID NO: 3964 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgccuucacuauggacuactt

SEQ ID NO: 3965 - RNA, 21 nt, Artificial Sequence
  Synthetic
  misc_feature (20)..(21): 2'-O-methyl
guaguccauagugaaggcguu

SEQ ID NO: 3966 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcguucuccucagauggutt

SEQ ID NO: 3967 - RNA, 21 nt, Artificial Sequence
  Synthetic
  misc_feature (20)..(21): 2'-O-methyl
accaucugaggagaacgcauu

SEQ ID NO: 3968 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuguaccggagcccuucatt

SEQ ID NO: 3969 - RNA, 21 nt, Artificial Sequence
  Synthetic
  misc_feature (20)..(21): 2'-O-methyl
ugaagggcuccgguacaacuu

SEQ ID NO: 3970 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgacaccaagaagcagagatt

SEQ ID NO: 3971 - RNA, 21 nt, Artificial Sequence
  Synthetic
  misc_feature (20)..(21): 2'-O-methyl
ucucugcuucuuggugucguu

SEQ ID NO: 3972 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaccaguggauucugugutt

SEQ ID NO: 3973 - RNA, 21 nt, Artificial Sequence
  Synthetic
  misc_feature (20)..(21): 2'-O-methyl
acacagaauccacuggugauu

SEQ ID NO: 3974 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggugacagggaagacaucatt

SEQ ID NO: 3975 - RNA, 21 nt, Artificial Sequence
  Synthetic
  misc_feature (20)..(21): 2'-O-methyl
ugaugucuucccugucaccuu

SEQ ID NO: 3976 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuaguaauaagccggcuatt

SEQ ID NO: 3977 - RNA, 21 nt, Artificial Sequence
  Synthetic
  misc_feature (20)..(21): 2'-O-methyl
uagccggcuuauuacuagauu

SEQ ID NO: 3978 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugguuaauaaggcugcagtt

SEQ ID NO: 3979 - RNA, 21 nt, Artificial Sequence
  Synthetic
  misc_feature (20)..(21): 2'-O-methyl
cugcagccuuauuaaccacuu

SEQ ID NO: 3980 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccucagauggugucugcutt

SEQ ID NO: 3981 - RNA, 21 nt, Artificial Sequence
  Synthetic
  misc_feature (20)..(21): 2'-O-methyl
agcagacaccaucugaggauu

SEQ ID NO: 3982 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggacaguaugcaaugactt

SEQ ID NO: 3983 - RNA, 21 nt, Artificial Sequence
  Synthetic
  misc_feature (20)..(21): 2'-O-methyl
gucauugcauacuguccauuu

SEQ ID NO: 3984 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcgugagcagggugccautt

SEQ ID NO: 3985 - RNA, 21 nt, Artificial Sequence
  Synthetic
  misc_feature (20)..(21): 2'-O-methyl
auggcacccugcucacgcauu

SEQ ID NO: 3986 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acucuaggaaugaaggugutt

SEQ ID NO: 3987 - RNA, 21 nt, Artificial Sequence
  Synthetic
  misc_feature (20)..(21): 2'-O-methyl
acaccuucauuccuagaguuu

SEQ ID NO: 3988 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacauuagaugagggcaugtt

SEQ ID NO: 3989 - RNA, 21 nt, Artificial Sequence
  Synthetic
  misc_feature (20)..(21): 2'-O-methyl
caugcccucaucuaaugucuu

SEQ ID NO: 3990 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuggugacagggaagacautt

SEQ ID NO: 3991 - RNA, 21 nt, Artificial Sequence
  Synthetic
  misc_feature (20)..(21): 2'-O-methyl
augucuucccugucaccaguu

SEQ ID NO: 3992 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauucgaaaucuugcccutt

SEQ ID NO: 3993 - RNA, 21 nt, Artificial Sequence
  Synthetic
  misc_feature (20)..(21): 2'-O-methyl
agggcaagauuucgaaucauu

SEQ ID NO: 3994 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucuuacacccaccaucctt

SEQ ID NO: 3995 - RNA, 21 nt, Artificial Sequence
  Synthetic
  misc_feature (20)..(21): 2'-O-methyl
ggaugguggguguaagagcuu

SEQ ID NO: 3996 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guccuucgggcuggugacatt

SEQ ID NO: 3997 - RNA, 21 nt, Artificial Sequence
  Synthetic
  misc_feature (20)..(21): 2'-O-methyl
ugucaccagcccgaaggacuu

SEQ ID NO: 3998 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcguacuguccuucgggtt

SEQ ID NO: 3999 - RNA, 21 nt, Artificial Sequence
  Synthetic
  misc_feature (20)..(21): 2'-O-methyl
cccgaaggacaguacgcacuu

SEQ ID NO: 4000 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggugcugacuauccaguutt

SEQ ID NO: 4001 - RNA, 21 nt, Artificial Sequence
  Synthetic
  misc_feature (20)..(21): 2'-O-methyl
aacuggauagucagcaccauu

SEQ ID NO: 4002 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuauugaagcugagggagtt

SEQ ID NO: 4003 - RNA, 21 nt, Artificial Sequence
  Synthetic
  misc_feature (20)..(21): 2'-O-methyl
cucccucagcuucaauagcuu

SEQ ID NO: 4004 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaccaagaaagcaagcuctt

SEQ ID NO: 4005 - RNA, 21 nt, Artificial Sequence
  Synthetic
  misc_feature (20)..(21): 2'-O-methyl
gagcuugcuuucuugguuguu

SEQ ID NO: 4006 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcagcugcuuuauucuctt

SEQ ID NO: 4007 - RNA, 21 nt, Artificial Sequence
  Synthetic
  misc_feature (20)..(21): 2'-O-methyl
gagaauaaagcagcugcacuu

SEQ ID NO: 4008 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaucugucugcucuaguatt

SEQ ID NO: 4009 - RNA, 21 nt, Artificial Sequence
  Synthetic
  misc_feature (20)..(21): 2'-O-methyl
uacuagagcagacagauaguu

SEQ ID NO: 4010 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaacaggaagggauggaagtt

SEQ ID NO: 4011 - RNA, 21 nt, Artificial Sequence
  Synthetic
  misc_feature (20)..(21): 2'-O-methyl
cuuccaucccuuccuguuuuu

SEQ ID NO: 4012 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuggcuagugguggaccctt

SEQ ID NO: 4013 - RNA, 21 nt, Artificial Sequence
  Synthetic
  misc_feature (20)..(21): 2'-O-methyl
ggguccaccacuagccaguuu

SEQ ID NO: 4014 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccucugugaacuugcucagtt

SEQ ID NO: 4015 - RNA, 21 nt, Artificial Sequence
  Synthetic
  misc_feature (20)..(21): 2'-O-methyl
cugagcaaguucacagagguu

SEQ ID NO: 4016 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caggaccucauggaugggctt

SEQ ID NO: 4017 - RNA, 21 nt, Artificial Sequence
  Synthetic
  misc_feature (20)..(21): 2'-O-methyl
gcccauccaugagguccuguu

SEQ ID NO: 4018 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguagaaacagcucguugutt

SEQ ID NO: 4019 - RNA, 21 nt, Artificial Sequence
  Synthetic
  misc_feature (20)..(21): 2'-O-methyl
acaacgagcuguuucuacauu

SEQ ID NO: 4020 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugacagauccaagucaactt

SEQ ID NO: 4021 - RNA, 21 nt, Artificial Sequence
  Synthetic
  misc_feature (20)..(21): 2'-O-methyl
guugacuuggaucugucaguu

SEQ ID NO: 4022 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaagaggauguggauacctt

SEQ ID NO: 4023 - RNA, 21 nt, Artificial Sequence
  Synthetic
  misc_feature (20)..(21): 2'-O-methyl
gguauccacauccucuuccuu

SEQ ID NO: 4024 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accaucacagaugcugaaatt

SEQ ID NO: 4025 - RNA, 21 nt, Artificial Sequence
  Synthetic
  misc_feature (20)..(21): 2'-O-methyl
uuucagcaucugugaugguuu

SEQ ID NO: 4026 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccguacguccaugggugggtt

SEQ ID NO: 4027 - RNA, 21 nt, Artificial Sequence
  Synthetic
  misc_feature (20)..(21): 2'-O-methyl
cccacccauggacguacgguu

SEQ ID NO: 4028 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauuccauuguuugugcagtt

SEQ ID NO: 4029 - RNA, 21 nt, Artificial Sequence
  Synthetic
  misc_feature (20)..(21): 2'-O-methyl
cugcacaaacaauggaauguu

SEQ ID NO: 4030 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacauccuagcucgggaugtt

SEQ ID NO: 4031 - RNA, 21 nt, Artificial Sequence
  Synthetic
  misc_feature (20)..(21): 2'-O-methyl
caucccgagcuaggauguguu

SEQ ID NO: 4032 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuccaggugacagcaaucatt

SEQ ID NO: 4033 - RNA, 21 nt, Artificial Sequence
  Synthetic
  misc_feature (20)..(21): 2'-O-methyl
ugauugcugucaccuggaguu

SEQ ID NO: 4034 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaccaguugugguuaagctt

SEQ ID NO: 4035 - RNA, 21 nt, Artificial Sequence
  Synthetic
  misc_feature (20)..(21): 2'-O-methyl
gcuuaaccacaacugguaguu

SEQ ID NO: 4036 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugugguuaagcucuuacatt

SEQ ID NO: 4037 - RNA, 21 nt, Artificial Sequence
  Synthetic
  misc_feature (20)..(21): 2'-O-methyl
uguaagagcuuaaccacaauu

SEQ ID NO: 4038 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaguaauaagccggcuauutt

SEQ ID NO: 4039 - RNA, 21 nt, Artificial Sequence
  Synthetic
  misc_feature (20)..(21): 2'-O-methyl
aauagccggcuuauuacuauu

SEQ ID NO: 4040 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguccuucacucaagaactt

SEQ ID NO: 4041 - RNA, 21 nt, Artificial Sequence
  Synthetic
  misc_feature (20)..(21): 2'-O-methyl
guucuugagugaaggacuguu

SEQ ID NO: 4042 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcugauuugauggaguugtt

SEQ ID NO: 4043 - RNA, 21 nt, Artificial Sequence
  Synthetic
  misc_feature (20)..(21): 2'-O-methyl
caacuccaucaaaucagcuuu

SEQ ID NO: 4044 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggucuccuugggacucuutt

SEQ ID NO: 4045 - RNA, 21 nt, Artificial Sequence
  Synthetic
  misc_feature (20)..(21): 2'-O-methyl
aagagucccaaggagaccuuu

SEQ ID NO: 4046 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuauggacuaccaguugutt

SEQ ID NO: 4047 - RNA, 21 nt, Artificial Sequence
  Synthetic
  misc_feature (20)..(21): 2'-O-methyl
acaacugguaguccauaguuu

SEQ ID NO: 4048 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagcagcaauuuguggaggtt

SEQ ID NO: 4049 - RNA, 21 nt, Artificial Sequence
  Synthetic
  misc_feature (20)..(21): 2'-O-methyl
ccuccacaaauugcugcuguu

SEQ ID NO: 4050 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgugcacaucaggauaccctt

SEQ ID NO: 4051 - RNA, 21 nt, Artificial Sequence
  Synthetic
  misc_feature (20)..(21): 2'-O-methyl
ggguauccugaugugcacguu

SEQ ID NO: 4052 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cguucuccucagauggugutt

SEQ ID NO: 4053 - RNA, 21 nt, Artificial Sequence
  Synthetic
  misc_feature (20)..(21): 2'-O-methyl
acaccaucugaggagaacguu

SEQ ID NO: 4054 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguaugcaaugacucgagtt

SEQ ID NO: 4055 - RNA, 21 nt, Artificial Sequence
  Synthetic
  misc_feature (20)..(21): 2'-O-methyl
cucgagucauugcauacuguu

SEQ ID NO: 4056 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguauagaggcucuugugctt

SEQ ID NO: 4057 - RNA, 21 nt, Artificial Sequence
  Synthetic
  misc_feature (20)..(21): 2'-O-methyl
gcacaagagccucuauaccuu

SEQ ID NO: 4058 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccaguugaugggcugcctt

SEQ ID NO: 4059 - RNA, 21 nt, Artificial Sequence
  Synthetic
  misc_feature (20)..(21): 2'-O-methyl
ggcagcccaucaacuggauuu

SEQ ID NO: 4060 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugccaagugggugguauagtt

SEQ ID NO: 4061 - RNA, 21 nt, Artificial Sequence
  Synthetic
  misc_feature (20)..(21): 2'-O-methyl
cuauaccacccacuuggcauu

SEQ ID NO: 4062 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaucaggauacccagcgctt

SEQ ID NO: 4063 - RNA, 21 nt, Artificial Sequence
  Synthetic
  misc_feature (20)..(21): 2'-O-methyl
gcgcuggguauccugauguuu

SEQ ID NO: 4064 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccaucuuuaagucuggagtt

SEQ ID NO: 4065 - RNA, 21 nt, Artificial Sequence
  Synthetic
  misc_feature (20)..(21): 2'-O-methyl
cuccagacuuaaagauggcuu

SEQ ID NO: 4066 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaccuuucccaucaucgugtt

SEQ ID NO: 4067 - RNA, 21 nt, Artificial Sequence
  Synthetic
  misc_feature (20)..(21): 2'-O-methyl
cacgaugaugggaaagguuuu

SEQ ID NO: 4068 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaguucaguugcuuguuctt

SEQ ID NO: 4069 - RNA, 21 nt, Artificial Sequence
  Synthetic
  misc_feature (20)..(21): 2'-O-methyl
gaacaagcaacugaacuaguu

SEQ ID NO: 4070 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucacucaagaacaaguagtt

SEQ ID NO: 4071 - RNA, 21 nt, Artificial Sequence
  Synthetic
  misc_feature (20)..(21): 2'-O-methyl
cuacuuguucuugagugaauu

SEQ ID NO: 4072 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggcucuugugcguacugutt

SEQ ID NO: 4073 - RNA, 21 nt, Artificial Sequence
  Synthetic
  misc_feature (20)..(21): 2'-O-methyl
acaguacgcacaagagccuuu

SEQ ID NO: 4074 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagaagcagagauggcccatt

SEQ ID NO: 4075 - RNA, 21 nt, Artificial Sequence
  Synthetic
  misc_feature (20)..(21): 2'-O-methyl
ugggccaucucugcuucuuuu

SEQ ID NO: 4076 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccucugacagaguuacuutt

SEQ ID NO: 4077 - RNA, 21 nt, Artificial Sequence
  Synthetic
  misc_feature (20)..(21): 2'-O-methyl
aaguaacucugucagaggauu

SEQ ID NO: 4078 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauuguuaucagaggacuatt

SEQ ID NO: 4079 - RNA, 21 nt, Artificial Sequence
  Synthetic
  misc_feature (20)..(21): 2'-O-methyl
uaguccucugauaacaauuuu

SEQ ID NO: 4080 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucucaguccuucacucaagtt

SEQ ID NO: 4081 - RNA, 21 nt, Artificial Sequence
  Synthetic
  misc_feature (20)..(21): 2'-O-methyl
cuugagugaaggacugagauu

SEQ ID NO: 4082 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccagacacgcuaucaugctt

SEQ ID NO: 4083 - RNA, 21 nt, Artificial Sequence
  Synthetic
  misc_feature (20)..(21): 2'-O-methyl
gcaugauagcgugucuggauu

SEQ ID NO: 4084 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacuaauguccagcguuugtt

SEQ ID NO: 4085 - RNA, 21 nt, Artificial Sequence
  Synthetic
  misc_feature (20)..(21): 2'-O-methyl
caaacgcuggacauuaguguu

SEQ ID NO: 4086 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuguaaccugcugugauactt

SEQ ID NO: 4087 - RNA, 21 nt, Artificial Sequence
  Synthetic
  misc_feature (20)..(21): 2'-O-methyl
guaucacagcagguuacaauu

SEQ ID NO: 4088 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuucuggguucagaugauatt

SEQ ID NO: 4089 - RNA, 21 nt, Artificial Sequence
  Synthetic
  misc_feature (20)..(21): 2'-O-methyl
uaucaucugaacccagaaguu

SEQ ID NO: 4090 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccguacguccauggguggtt

SEQ ID NO: 4091 - RNA, 21 nt, Artificial Sequence
  Synthetic
  misc_feature (20)..(21): 2'-O-methyl
ccacccauggacguacggcuu

SEQ ID NO: 4092 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaaugauguagaaacagctt

SEQ ID NO: 4093 - RNA, 21 nt, Artificial Sequence
  Synthetic
  misc_feature (20)..(21): 2'-O-methyl
gcuguuucuacaucauuuguu

SEQ ID NO: 4094 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaguugaagguuguaccggtt

SEQ ID NO: 4095 - RNA, 21 nt, Artificial Sequence
  Synthetic
  misc_feature (20)..(21): 2'-O-methyl
ccgguacaaccuucaacuauu

SEQ ID NO: 4096 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaggacaagccacaagauutt

SEQ ID NO: 4097 - RNA, 21 nt, Artificial Sequence
  Synthetic
  misc_feature (20)..(21): 2'-O-methyl
aaucuuguggcuuguccucuu

SEQ ID NO: 4098 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggagccacagcuccucugtt

SEQ ID NO: 4099 - RNA, 21 nt, Artificial Sequence
  Synthetic
  misc_feature (20)..(21): 2'-O-methyl
cagaggagcuguggcucccuu

SEQ ID NO: 4100 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuucaccugacagauccaatt

SEQ ID NO: 4101 - RNA, 21 nt, Artificial Sequence
  Synthetic
  misc_feature (20)..(21): 2'-O-methyl
uuggaucugucaggugaaguu

SEQ ID NO: 4102 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuuucagaugcugcaacutt

SEQ ID NO: 4103 - RNA, 21 nt, Artificial Sequence
  Synthetic
  misc_feature (20)..(21): 2'-O-methyl
aguugcagcaucugaaagauu

SEQ ID NO: 4104 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguaaccugcugugauacgtt

SEQ ID NO: 4105 - RNA, 21 nt, Artificial Sequence
  Synthetic
  misc_feature (20)..(21): 2'-O-methyl
cguaucacagcagguuacauu

SEQ ID NO: 4106 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccucccaaguccuguaugatt

SEQ ID NO: 4107 - RNA, 21 nt, Artificial Sequence
  Synthetic
  misc_feature (20)..(21): 2'-O-methyl
ucauacaggacuugggagguu

SEQ ID NO: 4108 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcagugcguuuagcuggutt

SEQ ID NO: 4109 - RNA, 21 nt, Artificial Sequence
  Synthetic
  misc_feature (20)..(21): 2'-O-methyl
accagcuaaacgcacugccuu

SEQ ID NO: 4110 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucuaguaauaagccggcutt

SEQ ID NO: 4111 - RNA, 21 nt, Artificial Sequence
  Synthetic
  misc_feature (20)..(21): 2'-O-methyl
agccggcuuauuacuagaguu

SEQ ID NO: 4112 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuguuagucacuggcagctt

SEQ ID NO: 4113 - RNA, 21 nt, Artificial Sequence
  Synthetic
  misc_feature (20)..(21): 2'-O-methyl
gcugccagugacuaacagcuu

SEQ ID NO: 4114 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucaacgucuuguucagaatt

SEQ ID NO: 4115 - RNA, 21 nt, Artificial Sequence
  Synthetic
  misc_feature (20)..(21): 2'-O-methyl
uucugaacaagacguugacuu

SEQ ID NO: 4116 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagaggauguggauaccutt

SEQ ID NO: 4117 - RNA, 21 nt, Artificial Sequence
  Synthetic
  misc_feature (20)..(21): 2'-O-methyl
agguauccacauccucuucuu

SEQ ID NO: 4118 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaccugcugugauacgautt

SEQ ID NO: 4119 - RNA, 21 nt, Artificial Sequence
  Synthetic
  misc_feature (20)..(21): 2'-O-methyl
aucguaucacagcagguuauu

SEQ ID NO: 4120 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaggaaucuuucagaugctt

SEQ ID NO: 4121 - RNA, 21 nt, Artificial Sequence
  Synthetic
  misc_feature (20)..(21): 2'-O-methyl
gcaucugaaagauuccugauu

SEQ ID NO: 4122 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaugauauaaauguggutt

SEQ ID NO: 4123 - RNA, 21 nt, Artificial Sequence
  Synthetic
  misc_feature (20)..(21): 2'-O-methyl
accacauuuauaucaucuguu

SEQ ID NO: 4124 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuauuuggaaccuuguuutt

SEQ ID NO: 4125 - RNA, 21 nt, Artificial Sequence
  Synthetic
  misc_feature (20)..(21): 2'-O-methyl
aaacaagguuccaaauaacuu

SEQ ID NO: 4126 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucacaaccgaauuguuauctt

SEQ ID NO: 4127 - RNA, 21 nt, Artificial Sequence
  Synthetic
  misc_feature (20)..(21): 2'-O-methyl
gauaacaauucgguugugauu

SEQ ID NO: 4128 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgggcuggugacagggaagtt

SEQ ID NO: 4129 - RNA, 21 nt, Artificial Sequence
  Synthetic
  misc_feature (20)..(21): 2'-O-methyl
cuucccugucaccagcccguu

SEQ ID NO: 4130 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaaccgaauuguuaucagtt

SEQ ID NO: 4131 - RNA, 21 nt, Artificial Sequence
  Synthetic
  misc_feature (20)..(21): 2'-O-methyl
cugauaacaauucgguuguuu

SEQ ID NO: 4132 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccacuaauguccagcguuutt

SEQ ID NO: 4133 - RNA, 21 nt, Artificial Sequence
  Synthetic
  misc_feature (20)..(21): 2'-O-methyl
aaacgcuggacauuagugguu

SEQ ID NO: 4134 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacugagccugccaucugutt

SEQ ID NO: 4135 - RNA, 21 nt, Artificial Sequence
  Synthetic
  misc_feature (20)..(21): 2'-O-methyl
acagauggcaggcucaguguu

SEQ ID NO: 4136 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguccaucagcuuucuaaatt

SEQ ID NO: 4137 - RNA, 21 nt, Artificial Sequence
  Synthetic
  misc_feature (20)..(21): 2'-O-methyl
uuuagaaagcugauggaccuu

SEQ ID NO: 4138 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugugaacuugcucaggactt

SEQ ID NO: 4139 - RNA, 21 nt, Artificial Sequence
  Synthetic
  misc_feature (20)..(21): 2'-O-methyl
guccugagcaaguucacaguu

SEQ ID NO: 4140 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucccaaaguuguuguaactt

SEQ ID NO: 4141 - RNA, 21 nt, Artificial Sequence
  Synthetic
  misc_feature (20)..(21): 2'-O-methyl
guuacaacaacuuugggauuu

SEQ ID NO: 4142 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaggaccuauacuuacgatt

SEQ ID NO: 4143 - RNA, 21 nt, Artificial Sequence
  Synthetic
  misc_feature (20)..(21): 2'-O-methyl
ucguaaguauagguccucauu

SEQ ID NO: 4144 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugucugaggacaagccacatt

SEQ ID NO: 4145 - RNA, 21 nt, Artificial Sequence
  Synthetic
  misc_feature (20)..(21): 2'-O-methyl
uguggcuuguccucagacauu

SEQ ID NO: 4146 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguugaugggcugccagautt

SEQ ID NO: 4147 - RNA, 21 nt, Artificial Sequence
  Synthetic
  misc_feature (20)..(21): 2'-O-methyl
aucuggcagcccaucaacuuu

SEQ ID NO: 4148 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaccagccgacaccaagatt

SEQ ID NO: 4149 - RNA, 21 nt, Artificial Sequence
  Synthetic
  misc_feature (20)..(21): 2'-O-methyl
ucuuggugucggcuggucauu

SEQ ID NO: 4150 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agggagccacagcuccucutt

SEQ ID NO: 4151 - RNA, 21 nt, Artificial Sequence
  Synthetic
  misc_feature (20)..(21): 2'-O-methyl
agaggagcuguggcucccuuu

SEQ ID NO: 4152 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaaguuguuguaaccugcutt

SEQ ID NO: 4153 - RNA, 21 nt, Artificial Sequence
  Synthetic
  misc_feature (20)..(21): 2'-O-methyl
agcagguuacaacaacuuuuu

SEQ ID NO: 4154 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugcaguuaugguccaucatt

SEQ ID NO: 4155 - RNA, 21 nt, Artificial Sequence
  Synthetic
  misc_feature (20)..(21): 2'-O-methyl
ugauggaccauaacugcaguu

SEQ ID NO: 4156 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaagguuguaccggagcctt

SEQ ID NO: 4157 - RNA, 21 nt, Artificial Sequence
  Synthetic
  misc_feature (20)..(21): 2'-O-methyl
ggcuccgguacaaccuucauu

SEQ ID NO: 4158 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugaaacaugcaguuguatt

SEQ ID NO: 4159 - RNA, 21 nt, Artificial Sequence
  Synthetic
  misc_feature (20)..(21): 2'-O-methyl
uacaacugcauguuucagcuu

SEQ ID NO: 4160 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaugcaagcuuuaggacuutt

SEQ ID NO: 4161 - RNA, 21 nt, Artificial Sequence
  Synthetic
  misc_feature (20)..(21): 2'-O-methyl
aaguccuaaagcuugcauuuu

SEQ ID NO: 4162 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucccugagacauuagaugtt

SEQ ID NO: 4163 - RNA, 21 nt, Artificial Sequence
  Synthetic
  misc_feature (20)..(21): 2'-O-methyl
caucuaaugucucagggaauu

SEQ ID NO: 4164 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuucgggcuggugacagggtt

SEQ ID NO: 4165 - RNA, 21 nt, Artificial Sequence
  Synthetic
  misc_feature (20)..(21): 2'-O-methyl
cccugucaccagcccgaaguu

SEQ ID NO: 4166 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugagcugaccagcucucutt

SEQ ID NO: 4167 - RNA, 21 nt, Artificial Sequence
  Synthetic
  misc_feature (20)..(21): 2'-O-methyl
agagagcuggucagcucaauu

SEQ ID NO: 4168 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaacuugcucaggacaaggtt

SEQ ID NO: 4169 - RNA, 21 nt, Artificial Sequence
  Synthetic
  misc_feature (20)..(21): 2'-O-methyl
ccuuguccugagcaaguucuu

SEQ ID NO: 4170 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccagccgacaccaagaagctt

SEQ ID NO: 4171 - RNA, 21 nt, Artificial Sequence
  Synthetic
  misc_feature (20)..(21): 2'-O-methyl
gcuucuuggugucggcugguu

SEQ ID NO: 4172 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agggugccauuccacgacutt

SEQ ID NO: 4173 - RNA, 21 nt, Artificial Sequence
  Synthetic
  misc_feature (20)..(21): 2'-O-methyl
agucguggaauggcacccuuu

SEQ ID NO: 4174 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugugcagcugcuuuauuctt

SEQ ID NO: 4175 - RNA, 21 nt, Artificial Sequence
  Synthetic
  misc_feature (20)..(21): 2'-O-methyl
gaauaaagcagcugcacaauu

SEQ ID NO: 4176 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auauaaugaggaccuauactt

SEQ ID NO: 4177 - RNA, 21 nt, Artificial Sequence
  Synthetic
  misc_feature (20)..(21): 2'-O-methyl
guauagguccucauuauauuu

SEQ ID NO: 4178 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucacucaagaacaaguagctt

SEQ ID NO: 4179 - RNA, 21 nt, Artificial Sequence
  Synthetic
  misc_feature (20)..(21): 2'-O-methyl
gcuacuuguucuugagugauu

SEQ ID NO: 4180 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugguggaaugcaagcuutt

SEQ ID NO: 4181 - RNA, 21 nt, Artificial Sequence
  Synthetic
  misc_feature (20)..(21): 2'-O-methyl
aagcuugcauuccaccagcuu

SEQ ID NO: 4182 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaacuaaacaggaagggatt

SEQ ID NO: 4183 - RNA, 21 nt, Artificial Sequence
  Synthetic
  misc_feature (20)..(21): 2'-O-methyl
ucccuuccuguuuaguugcuu

SEQ ID NO: 4184 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agguuguaccggagcccuutt

SEQ ID NO: 4185 - RNA, 21 nt, Artificial Sequence
  Synthetic
  misc_feature (20)..(21): 2'-O-methyl
aagggcuccgguacaaccuuu

SEQ ID NO: 4186 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggcugcaguuaugguccatt

SEQ ID NO: 4187 - RNA, 21 nt, Artificial Sequence
  Synthetic
  misc_feature (20)..(21): 2'-O-methyl
uggaccauaacugcagccuuu

SEQ ID NO: 4188 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcagaucccaucuacacagtt

SEQ ID NO: 4189 - RNA, 21 nt, Artificial Sequence
  Synthetic
  misc_feature (20)..(21): 2'-O-methyl
cuguguagaugggaucugcuu

SEQ ID NO: 4190 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuaggaaugaagguguggctt

SEQ ID NO: 4191 - RNA, 21 nt, Artificial Sequence
  Synthetic
  misc_feature (20)..(21): 2'-O-methyl
gccacaccuucauuccuaguu

SEQ ID NO: 4192 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcuccuucucugaguggutt

SEQ ID NO: 4193 - RNA, 21 nt, Artificial Sequence
  Synthetic
  misc_feature (20)..(21): 2'-O-methyl
accacucagagaaggagcuuu

SEQ ID NO: 4194 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuacaacucuccacaaccutt

SEQ ID NO: 4195 - RNA, 21 nt, Artificial Sequence
  Synthetic
  misc_feature (20)..(21): 2'-O-methyl
agguuguggagaguuguaauu

SEQ ID NO: 4196 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguaaaggcaauccugaggtt

SEQ ID NO: 4197 - RNA, 21 nt, Artificial Sequence
  Synthetic
  misc_feature (20)..(21): 2'-O-methyl
ccucaggauugccuuuaccuu

SEQ ID NO: 4198 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guucgccuucacuauggactt

SEQ ID NO: 4199 - RNA, 21 nt, Artificial Sequence
  Synthetic
  misc_feature (20)..(21): 2'-O-methyl
guccauagugaaggcgaacuu

SEQ ID NO: 4200 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaauguuaaauucuuggctt

SEQ ID NO: 4201 - RNA, 21 nt, Artificial Sequence
  Synthetic
  misc_feature (20)..(21): 2'-O-methyl
gccaagaauuuaacauuuguu

SEQ ID NO: 4202 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugugauacgaugcuucaatt

SEQ ID NO: 4203 - RNA, 21 nt, Artificial Sequence
  Synthetic
  misc_feature (20)..(21): 2'-O-methyl
uugaagcaucguaucacaguu

SEQ ID NO: 4204 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaaaugauguagaaacagtt

SEQ ID NO: 4205 - RNA, 21 nt, Artificial Sequence
  Synthetic
  misc_feature (20)..(21): 2'-O-methyl
cuguuucuacaucauuuguuu

SEQ ID NO: 4206 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguacgagcugcuauguuctt

SEQ ID NO: 4207 - RNA, 21 nt, Artificial Sequence
  Synthetic
  misc_feature (20)..(21): 2'-O-methyl
gaacauagcagcucguaccuu

SEQ ID NO: 4208 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaauuguuaucagaggacutt

SEQ ID NO: 4209 - RNA, 21 nt, Artificial Sequence
  Synthetic
  misc_feature (20)..(21): 2'-O-methyl
aguccucugauaacaauucuu

SEQ ID NO: 4210 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caaccgaauuguuaucagatt

SEQ ID NO: 4211 - RNA, 21 nt, Artificial Sequence
  Synthetic
  misc_feature (20)..(21): 2'-O-methyl
ucugauaacaauucgguuguu

SEQ ID NO: 4212 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugauacgaugcuucaagatt

SEQ ID NO: 4213 - RNA, 21 nt, Artificial Sequence
  Synthetic
  misc_feature (20)..(21): 2'-O-methyl
ucuugaagcaucguaucacuu

SEQ ID NO: 4214 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaaggcaauccugaggaagtt

SEQ ID NO: 4215 - RNA, 21 nt, Artificial Sequence
  Synthetic
  misc_feature (20)..(21): 2'-O-methyl
cuuccucaggauugccuuuuu

SEQ ID NO: 4216 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagcuccucugacagaguutt

SEQ ID NO: 4217 - RNA, 21 nt, Artificial Sequence
  Synthetic
  misc_feature (20)..(21): 2'-O-methyl
aacucugucagaggagcuguu

SEQ ID NO: 4218 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucaucccacuaauguccatt

SEQ ID NO: 4219 - RNA, 21 nt, Artificial Sequence
  Synthetic
  misc_feature (20)..(21): 2'-O-methyl
uggacauuagugggaugaguu

SEQ ID NO: 4220 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggucugccaagugggugtt

SEQ ID NO: 4221 - RNA, 21 nt, Artificial Sequence
  Synthetic
  misc_feature (20)..(21): 2'-O-methyl
cacccacuuggcagaccauuu

SEQ ID NO: 4222 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuacuguuggauugauuctt

SEQ ID NO: 4223 - RNA, 21 nt, Artificial Sequence
  Synthetic
  misc_feature (20)..(21): 2'-O-methyl
gaaucaauccaacaguagcuu

SEQ ID NO: 4224 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcaaugacucgagcucagtt

SEQ ID NO: 4225 - RNA, 21 nt, Artificial Sequence
  Synthetic
  misc_feature (20)..(21): 2'-O-methyl
cugagcucgagucauugcauu

SEQ ID NO: 4226 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacuugauauuggugcccatt

SEQ ID NO: 4227 - RNA, 21 nt, Artificial Sequence
  Synthetic
  misc_feature (20)..(21): 2'-O-methyl
ugggcaccaauaucaagucuu

SEQ ID NO: 4228 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugucugcuauuguacguactt

SEQ ID NO: 4229 - RNA, 21 nt, Artificial Sequence
  Synthetic
  misc_feature (20)..(21): 2'-O-methyl
guacguacaauagcagacauu

SEQ ID NO: 4230 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaacugucuuuggacuctt

SEQ ID NO: 4231 - RNA, 21 nt, Artificial Sequence
  Synthetic
  misc_feature (20)..(21): 2'-O-methyl
gaguccaaagacaguucuguu

SEQ ID NO: 4232 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaguucaguugcuuguucgtt

SEQ ID NO: 4233 - RNA, 21 nt, Artificial Sequence
  Synthetic
  misc_feature (20)..(21): 2'-O-methyl
cgaacaagcaacugaacuauu

SEQ ID NO: 4234 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acagacugccuucaaauuutt

SEQ ID NO: 4235 - RNA, 21 nt, Artificial Sequence
  Synthetic
  misc_feature (20)..(21): 2'-O-methyl
aaauuugaaggcagucuguuu

SEQ ID NO: 4236 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggugguauagaggcucuutt

SEQ ID NO: 4237 - RNA, 21 nt, Artificial Sequence
  Synthetic
  misc_feature (20)..(21): 2'-O-methyl
aagagccucuauaccacccuu

SEQ ID NO: 4238 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggacuaccaguuguggutt

SEQ ID NO: 4239 - RNA, 21 nt, Artificial Sequence
  Synthetic
  misc_feature (20)..(21): 2'-O-methyl
accacaacugguaguccauuu

SEQ ID NO: 4240 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuguuaucagaggacuaatt

SEQ ID NO: 4241 - RNA, 21 nt, Artificial Sequence
  Synthetic
  misc_feature (20)..(21): 2'-O-methyl
uuaguccucugauaacaauuu

SEQ ID NO: 4242 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaggcugcaguuaugguctt

SEQ ID NO: 4243 - RNA, 21 nt, Artificial Sequence
  Synthetic
  misc_feature (20)..(21): 2'-O-methyl
gaccauaacugcagccuuauu

SEQ ID NO: 4244 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaaucuugcccuuuguccctt

SEQ ID NO: 4245 - RNA, 21 nt, Artificial Sequence
  Synthetic
  misc_feature (20)..(21): 2'-O-methyl
gggacaaagggcaagauuuuu

SEQ ID NO: 4246 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcagcaauuuguggagggtt

SEQ ID NO: 4247 - RNA, 21 nt, Artificial Sequence
  Synthetic
  misc_feature (20)..(21): 2'-O-methyl
cccuccacaaauugcugcuuu

SEQ ID NO: 4248 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaggacuaaauaccauuctt

SEQ ID NO: 4249 - RNA, 21 nt, Artificial Sequence
  Synthetic
  misc_feature (20)..(21): 2'-O-methyl
gaaugguauuuaguccucuuu

SEQ ID NO: 4250 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugaaggugcuaucuguctt

SEQ ID NO: 4251 - RNA, 21 nt, Artificial Sequence
  Synthetic
  misc_feature (20)..(21): 2'-O-methyl
gacagauagcaccuucagcuu

SEQ ID NO: 4252 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguaugagugggaacagggtt

SEQ ID NO: 4253 - RNA, 21 nt, Artificial Sequence
  Synthetic
  misc_feature (20)..(21): 2'-O-methyl
cccuguucccacucauacauu

SEQ ID NO: 4254 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accaugcagaauacaaaugtt

SEQ ID NO: 4255 - RNA, 21 nt, Artificial Sequence
  Synthetic
  misc_feature (20)..(21): 2'-O-methyl
cauuuguauucugcaugguuu

SEQ ID NO: 4256 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaucccaucuacacagutt

SEQ ID NO: 4257 - RNA, 21 nt, Artificial Sequence
  Synthetic
  misc_feature (20)..(21): 2'-O-methyl
acuguguagaugggaucuguu

SEQ ID NO: 4258 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacacagcagcaauuugugtt

SEQ ID NO: 4259 - RNA, 21 nt, Artificial Sequence
  Synthetic
  misc_feature (20)..(21): 2'-O-methyl
cacaaauugcugcugugucuu

SEQ ID NO: 4260 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggcaugcagaucccaucutt

SEQ ID NO: 4261 - RNA, 21 nt, Artificial Sequence
  Synthetic
  misc_feature (20)..(21): 2'-O-methyl
agaugggaucugcaugcccuu

SEQ ID NO: 4262 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caugcccaggaccucauggtt

SEQ ID NO: 4263 - RNA, 21 nt, Artificial Sequence
  Synthetic
  misc_feature (20)..(21): 2'-O-methyl
ccaugagguccugggcauguu

SEQ ID NO: 4264 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagcugagggagccacagtt

SEQ ID NO: 4265 - RNA, 21 nt, Artificial Sequence
  Synthetic
  misc_feature (20)..(21): 2'-O-methyl
cuguggcucccucagcuucuu

SEQ ID NO: 4266 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuguuagucacuggcagcatt

SEQ ID NO: 4267 - RNA, 21 nt, Artificial Sequence
  Synthetic
  misc_feature (20)..(21): 2'-O-methyl
ugcugccagugacuaacaguu

SEQ ID NO: 4268 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuguucagcuucuggguutt

SEQ ID NO: 4269 - RNA, 21 nt, Artificial Sequence
  Synthetic
  misc_feature (20)..(21): 2'-O-methyl
aacccagaagcugaacaaguu

SEQ ID NO: 4270 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcguacuguccuucgggcutt

SEQ ID NO: 4271 - RNA, 21 nt, Artificial Sequence
  Synthetic
  misc_feature (20)..(21): 2'-O-methyl
agcccgaaggacaguacgcuu

SEQ ID NO: 4272 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcccagaaugcaguucgcctt

SEQ ID NO: 4273 - RNA, 21 nt, Artificial Sequence
  Synthetic
  misc_feature (20)..(21): 2'-O-methyl
ggcgaacugcauucugggcuu

SEQ ID NO: 4274 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcugguggaaugcaagctt

SEQ ID NO: 4275 - RNA, 21 nt, Artificial Sequence
  Synthetic
  misc_feature (20)..(21): 2'-O-methyl
gcuugcauuccaccagcuuuu

SEQ ID NO: 4276 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaggauguggauaccuccctt

SEQ ID NO: 4277 - RNA, 21 nt, Artificial Sequence
  Synthetic
  misc_feature (20)..(21): 2'-O-methyl
gggagguauccacauccucuu

SEQ ID NO: 4278 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaaauguggucaccugugtt

SEQ ID NO: 4279 - RNA, 21 nt, Artificial Sequence
  Synthetic
  misc_feature (20)..(21): 2'-O-methyl
cacaggugaccacauuuauuu

SEQ ID NO: 4280 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacguccaugggugggacatt

SEQ ID NO: 4281 - RNA, 21 nt, Artificial Sequence
  Synthetic
  misc_feature (20)..(21): 2'-O-methyl
ugucccacccauggacguauu

SEQ ID NO: 4282 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauggaguuggacauggcctt

SEQ ID NO: 4283 - RNA, 21 nt, Artificial Sequence
  Synthetic
  misc_feature (20)..(21): 2'-O-methyl
ggccauguccaacuccaucuu

SEQ ID NO: 4284 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguccagcguuuggcugaatt

SEQ ID NO: 4285 - RNA, 21 nt, Artificial Sequence
  Synthetic
  misc_feature (20)..(21): 2'-O-methyl
uucagccaaacgcuggacauu

SEQ ID NO: 4286 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agacaucacugagccugcctt

SEQ ID NO: 4287 - RNA, 21 nt, Artificial Sequence
  Synthetic
  misc_feature (20)..(21): 2'-O-methyl
ggcaggcucagugaugucuuu

SEQ ID NO: 4288 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagcagggugccauuccactt

SEQ ID NO: 4289 - RNA, 21 nt, Artificial Sequence
  Synthetic
  misc_feature (20)..(21): 2'-O-methyl
guggaauggcacccugcucuu

SEQ ID NO: 4290 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaauauaaugaggaccuautt

SEQ ID NO: 4291 - RNA, 21 nt, Artificial Sequence
  Synthetic
  misc_feature (20)..(21): 2'-O-methyl
auagguccucauuauauuuuu

SEQ ID NO: 4292 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacuggcuagugguggacctt

SEQ ID NO: 4293 - RNA, 21 nt, Artificial Sequence
  Synthetic
  misc_feature (20)..(21): 2'-O-methyl
gguccaccacuagccaguauu

SEQ ID NO: 4294 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcuugguucaccaguggatt

SEQ ID NO: 4295 - RNA, 21 nt, Artificial Sequence
  Synthetic
  misc_feature (20)..(21): 2'-O-methyl
uccacuggugaaccaagcauu

SEQ ID NO: 4296 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugaggacaagccacaagatt

SEQ ID NO: 4297 - RNA, 21 nt, Artificial Sequence
  Synthetic
  misc_feature (20)..(21): 2'-O-methyl
ucuuguggcuuguccucaguu

SEQ ID NO: 4298 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuugugcguacuguccuuctt

SEQ ID NO: 4299 - RNA, 21 nt, Artificial Sequence
  Synthetic
  misc_feature (20)..(21): 2'-O-methyl
gaaggacaguacgcacaaguu

SEQ ID NO: 4300 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguuauuuggaaccuuguutt

SEQ ID NO: 4301 - RNA, 21 nt, Artificial Sequence
  Synthetic
  misc_feature (20)..(21): 2'-O-methyl
aacaagguuccaaauaacauu

SEQ ID NO: 4302 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagcuuauggcaaccaagatt

SEQ ID NO: 4303 - RNA, 21 nt, Artificial Sequence
  Synthetic
  misc_feature (20)..(21): 2'-O-methyl
ucuugguugccauaagcuauu

SEQ ID NO: 4304 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugauacgaugcuucaagagtt

SEQ ID NO: 4305 - RNA, 21 nt, Artificial Sequence
  Synthetic
  misc_feature (20)..(21): 2'-O-methyl
cucuugaagcaucguaucauu

SEQ ID NO: 4306 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugguauagaggcucuugugtt

SEQ ID NO: 4307 - RNA, 21 nt, Artificial Sequence
  Synthetic
  misc_feature (20)..(21): 2'-O-methyl
cacaagagccucuauaccauu

SEQ ID NO: 4308 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauguagaaacagcucguutt

SEQ ID NO: 4309 - RNA, 21 nt, Artificial Sequence
  Synthetic
  misc_feature (20)..(21): 2'-O-methyl
aacgagcuguuucuacaucuu

SEQ ID NO: 4310 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuuucccaucaucgugagtt

SEQ ID NO: 4311 - RNA, 21 nt, Artificial Sequence
  Synthetic
  misc_feature (20)..(21): 2'-O-methyl
cucacgaugaugggaaagguu

SEQ ID NO: 4312 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcguucuccucagauggugtt

SEQ ID NO: 4313 - RNA, 21 nt, Artificial Sequence
  Synthetic
  misc_feature (20)..(21): 2'-O-methyl
caccaucugaggagaacgcuu

SEQ ID NO: 4314 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucaggauacccagcgccgutt

SEQ ID NO: 4315 - RNA, 21 nt, Artificial Sequence
  Synthetic
  misc_feature (20)..(21): 2'-O-methyl
acggcgcuggguauccugauu

SEQ ID NO: 4316 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acggcuuucaguugagcugtt

SEQ ID NO: 4317 - RNA, 21 nt, Artificial Sequence
  Synthetic
  misc_feature (20)..(21): 2'-O-methyl
cagcucaacugaaagccguuu

SEQ ID NO: 4318 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guugaagguuguaccggagtt

SEQ ID NO: 4319 - RNA, 21 nt, Artificial Sequence
  Synthetic
  misc_feature (20)..(21): 2'-O-methyl
cuccgguacaaccuucaacuu

SEQ ID NO: 4320 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaucgccaggaugauccuatt

SEQ ID NO: 4321 - RNA, 21 nt, Artificial Sequence
  Synthetic
  misc_feature (20)..(21): 2'-O-methyl
uaggaucauccuggcgauauu

SEQ ID NO: 4322 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcugaaggugcuaucugtt

SEQ ID NO: 4323 - RNA, 21 nt, Artificial Sequence
  Synthetic
  misc_feature (20)..(21): 2'-O-methyl
cagauagcaccuucagcacuu

SEQ ID NO: 4324 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucuuuggacucucaggaatt

SEQ ID NO: 4325 - RNA, 21 nt, Artificial Sequence
  Synthetic
  misc_feature (20)..(21): 2'-O-methyl
uuccugagaguccaaagacuu

SEQ ID NO: 4326 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggauggaaggucuccuugtt

SEQ ID NO: 4327 - RNA, 21 nt, Artificial Sequence
  Synthetic
  misc_feature (20)..(21): 2'-O-methyl
caaggagaccuuccaucccuu

SEQ ID NO: 4328 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugagcugaccagcucucuctt

SEQ ID NO: 4329 - RNA, 21 nt, Artificial Sequence
  Synthetic
  misc_feature (20)..(21): 2'-O-methyl
gagagagcuggucagcucauu

SEQ ID NO: 4330 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuucccaucaucgugaggtt

SEQ ID NO: 4331 - RNA, 21 nt, Artificial Sequence
  Synthetic
  misc_feature (20)..(21): 2'-O-methyl
ccucacgaugaugggaaaguu

SEQ ID NO: 4332 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcuuuaggacuucaccutt

SEQ ID NO: 4333 - RNA, 21 nt, Artificial Sequence
  Synthetic
  misc_feature (20)..(21): 2'-O-methyl
aggugaaguccuaaagcuuuu

SEQ ID NO: 4334 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaaugcaagcuuuaggatt

SEQ ID NO: 4335 - RNA, 21 nt, Artificial Sequence
  Synthetic
  misc_feature (20)..(21): 2'-O-methyl
uccuaaagcuugcauuccauu

SEQ ID NO: 4336 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuggaggcauuccugcccutt

SEQ ID NO: 4337 - RNA, 21 nt, Artificial Sequence
  Synthetic
  misc_feature (20)..(21): 2'-O-methyl
agggcaggaaugccuccaguu

SEQ ID NO: 4338 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguucaguugcuuguucgutt

SEQ ID NO: 4339 - RNA, 21 nt, Artificial Sequence
  Synthetic
  misc_feature (20)..(21): 2'-O-methyl
acgaacaagcaacugaacuuu

SEQ ID NO: 4340 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gagcugcuauguucccugatt

SEQ ID NO: 4341 - RNA, 21 nt, Artificial Sequence
  Synthetic
  misc_feature (20)..(21): 2'-O-methyl
ucagggaacauagcagcucuu

SEQ ID NO: 4342 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggccaggaugccuuggguatt

SEQ ID NO: 4343 - RNA, 21 nt, Artificial Sequence
  Synthetic
  misc_feature (20)..(21): 2'-O-methyl
uacccaaggcauccuggccuu

SEQ ID NO: 4344 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugauccuagcuaucguutt

SEQ ID NO: 4345 - RNA, 21 nt, Artificial Sequence
  Synthetic
  misc_feature (20)..(21): 2'-O-methyl
aacgauagcuaggaucaucuu

SEQ ID NO: 4346 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauugauucgaaaucuugctt

SEQ ID NO: 4347 - RNA, 21 nt, Artificial Sequence
  Synthetic
  misc_feature (20)..(21): 2'-O-methyl
gcaagauuucgaaucaaucuu

SEQ ID NO: 4348 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagagauggcccagaaugctt

SEQ ID NO: 4349 - RNA, 21 nt, Artificial Sequence
  Synthetic
  misc_feature (20)..(21): 2'-O-methyl
gcauucugggccaucucuguu

SEQ ID NO: 4350 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagcgccguacguccauggtt

SEQ ID NO: 4351 - RNA, 21 nt, Artificial Sequence
  Synthetic
  misc_feature (20)..(21): 2'-O-methyl
ccauggacguacggcgcuguu

SEQ ID NO: 4352 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auguagaaacagcucguugtt

SEQ ID NO: 4353 - RNA, 21 nt, Artificial Sequence
  Synthetic
  misc_feature (20)..(21): 2'-O-methyl
caacgagcuguuucuacauuu

SEQ ID NO: 4354 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agugcugaaggugcuaucutt

SEQ ID NO: 4355 - RNA, 21 nt, Artificial Sequence
  Synthetic
  misc_feature (20)..(21): 2'-O-methyl
agauagcaccuucagcacuuu

SEQ ID NO: 4356 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacuaccaguugugguuaatt

SEQ ID NO: 4357 - RNA, 21 nt, Artificial Sequence
  Synthetic
  misc_feature (20)..(21): 2'-O-methyl
uuaaccacaacugguagucuu

SEQ ID NO: 4358 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaggaagggauggaaggutt

SEQ ID NO: 4359 - RNA, 21 nt, Artificial Sequence
  Synthetic
  misc_feature (20)..(21): 2'-O-methyl
accuuccaucccuuccuguuu

SEQ ID NO: 4360 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagguggugguuaauaaggtt

SEQ ID NO: 4361 - RNA, 21 nt, Artificial Sequence
  Synthetic
  misc_feature (20)..(21): 2'-O-methyl
ccuuauuaaccaccaccuguu

SEQ ID NO: 4362 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaggcugcaguuauggucctt

SEQ ID NO: 4363 - RNA, 21 nt, Artificial Sequence
  Synthetic
  misc_feature (20)..(21): 2'-O-methyl
ggaccauaacugcagccuuuu

SEQ ID NO: 4364 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaauguggucaccugugctt

SEQ ID NO: 4365 - RNA, 21 nt, Artificial Sequence
  Synthetic
  misc_feature (20)..(21): 2'-O-methyl
gcacaggugaccacauuuauu

SEQ ID NO: 4366 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaaggcuacuguuggauutt

SEQ ID NO: 4367 - RNA, 21 nt, Artificial Sequence
  Synthetic
  misc_feature (20)..(21): 2'-O-methyl
aauccaacaguagccuuuauu

SEQ ID NO: 4368 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauggacaguaugcaaugatt

SEQ ID NO: 4369 - RNA, 21 nt, Artificial Sequence
  Synthetic
  misc_feature (20)..(21): 2'-O-methyl
ucauugcauacuguccaucuu

SEQ ID NO: 4370 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucuggguucagaugauautt

SEQ ID NO: 4371 - RNA, 21 nt, Artificial Sequence
  Synthetic
  misc_feature (20)..(21): 2'-O-methyl
auaucaucugaacccagaauu

SEQ ID NO: 4372 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guacuguccuucgggcuggtt

SEQ ID NO: 4373 - RNA, 21 nt, Artificial Sequence
  Synthetic
  misc_feature (20)..(21): 2'-O-methyl
ccagcccgaaggacaguacuu

SEQ ID NO: 4374 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuugguucaccaguggauutt

SEQ ID NO: 4375 - RNA, 21 nt, Artificial Sequence
  Synthetic
  misc_feature (20)..(21): 2'-O-methyl
aauccacuggugaaccaaguu

SEQ ID NO: 4376 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauugaagcugagggagcctt

SEQ ID NO: 4377 - RNA, 21 nt, Artificial Sequence
  Synthetic
  misc_feature (20)..(21): 2'-O-methyl
ggcucccucagcuucaauauu

SEQ ID NO: 4378 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuguuguaaccugcugugtt

SEQ ID NO: 4379 - RNA, 21 nt, Artificial Sequence
  Synthetic
  misc_feature (20)..(21): 2'-O-methyl
cacagcagguuacaacaacuu

SEQ ID NO: 4380 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcagggugccauuccacgtt

SEQ ID NO: 4381 - RNA, 21 nt, Artificial Sequence
  Synthetic
  misc_feature (20)..(21): 2'-O-methyl
cguggaauggcacccugcuuu

SEQ ID NO: 4382 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guccucugugaacuugcuctt

SEQ ID NO: 4383 - RNA, 21 nt, Artificial Sequence
  Synthetic
  misc_feature (20)..(21): 2'-O-methyl
gagcaaguucacagaggacuu

SEQ ID NO: 4384 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugaccagccgacaccaatt

SEQ ID NO: 4385 - RNA, 21 nt, Artificial Sequence
  Synthetic
  misc_feature (20)..(21): 2'-O-methyl
uuggugucggcuggucagauu

SEQ ID NO: 4386 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auugaagcugagggagccatt

SEQ ID NO: 4387 - RNA, 21 nt, Artificial Sequence
  Synthetic
  misc_feature (20)..(21): 2'-O-methyl
uggcucccucagcuucaauuu

SEQ ID NO: 4388 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccauggaaccagacagaatt

SEQ ID NO: 4389 - RNA, 21 nt, Artificial Sequence
  Synthetic
  misc_feature (20)..(21): 2'-O-methyl
uucugucugguuccauggcuu

SEQ ID NO: 4390 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagcuauugaagcugagggtt

SEQ ID NO: 4391 - RNA, 21 nt, Artificial Sequence
  Synthetic
  misc_feature (20)..(21): 2'-O-methyl
cccucagcuucaauagcuuuu

SEQ ID NO: 4392 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauucgaaaucuugcccuutt

SEQ ID NO: 4393 - RNA, 21 nt, Artificial Sequence
  Synthetic
  misc_feature (20)..(21): 2'-O-methyl
aagggcaagauuucgaaucuu

SEQ ID NO: 4394 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aguugcuuguucgugcacatt

SEQ ID NO: 4395 - RNA, 21 nt, Artificial Sequence
  Synthetic
  misc_feature (20)..(21): 2'-O-methyl
ugugcacgaacaagcaacuuu

SEQ ID NO: 4396 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagaacaagaugauggucutt

SEQ ID NO: 4397 - RNA, 21 nt, Artificial Sequence
  Synthetic
  misc_feature (20)..(21): 2'-O-methyl
agaccaucaucuuguucuuuu

SEQ ID NO: 4398 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agugguaaaggcaauccugtt

SEQ ID NO: 4399 - RNA, 21 nt, Artificial Sequence
  Synthetic
  misc_feature (20)..(21): 2'-O-methyl
caggauugccuuuaccacuuu

SEQ ID NO: 4400 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagaugcugcaacuaaacatt

SEQ ID NO: 4401 - RNA, 21 nt, Artificial Sequence
  Synthetic
  misc_feature (20)..(21): 2'-O-methyl
uguuuaguugcagcaucuguu

SEQ ID NO: 4402 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccugagacauuagaugaggtt

SEQ ID NO: 4403 - RNA, 21 nt, Artificial Sequence
  Synthetic
  misc_feature (20)..(21): 2'-O-methyl
ccucaucuaaugucucagguu

SEQ ID NO: 4404 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucccaaaguuguuguaacctt

SEQ ID NO: 4405 - RNA, 21 nt, Artificial Sequence
  Synthetic
  misc_feature (20)..(21): 2'-O-methyl
gguuacaacaacuuugggauu

SEQ ID NO: 4406 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacaugcaguuguaaacuutt

SEQ ID NO: 4407 - RNA, 21 nt, Artificial Sequence
  Synthetic
  misc_feature (20)..(21): 2'-O-methyl
aaguuuacaacugcauguuuu

SEQ ID NO: 4408 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggugucugcuauuguactt

SEQ ID NO: 4409 - RNA, 21 nt, Artificial Sequence
  Synthetic
  misc_feature (20)..(21): 2'-O-methyl
guacaauagcagacaccauuu

SEQ ID NO: 4410 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugaccagccgacaccaagtt

SEQ ID NO: 4411 - RNA, 21 nt, Artificial Sequence
  Synthetic
  misc_feature (20)..(21): 2'-O-methyl
cuuggugucggcuggucaguu

SEQ ID NO: 4412 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccaaagaguagcugcagtt

SEQ ID NO: 4413 - RNA, 21 nt, Artificial Sequence
  Synthetic
  misc_feature (20)..(21): 2'-O-methyl
cugcagcuacucuuuggauuu

SEQ ID NO: 4414 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auguccagcguuuggcugatt

SEQ ID NO: 4415 - RNA, 21 nt, Artificial Sequence
  Synthetic
  misc_feature (20)..(21): 2'-O-methyl
ucagccaaacgcuggacauuu

SEQ ID NO: 4416 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuugugcguacuguccuutt

SEQ ID NO: 4417 - RNA, 21 nt, Artificial Sequence
  Synthetic
  misc_feature (20)..(21): 2'-O-methyl
aaggacaguacgcacaagauu

SEQ ID NO: 4418 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggauguggauaccucccatt

SEQ ID NO: 4419 - RNA, 21 nt, Artificial Sequence
  Synthetic
  misc_feature (20)..(21): 2'-O-methyl
ugggagguauccacauccuuu

SEQ ID NO: 4420 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcugcaguuaugguccautt

SEQ ID NO: 4421 - RNA, 21 nt, Artificial Sequence
  Synthetic
  misc_feature (20)..(21): 2'-O-methyl
auggaccauaacugcagccuu

SEQ ID NO: 4422 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucacauccuagcucgggautt

SEQ ID NO: 4423 - RNA, 21 nt, Artificial Sequence
  Synthetic
  misc_feature (20)..(21): 2'-O-methyl
aucccgagcuaggaugugauu

SEQ ID NO: 4424 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accaagaagcagagauggctt

SEQ ID NO: 4425 - RNA, 21 nt, Artificial Sequence
  Synthetic
  misc_feature (20)..(21): 2'-O-methyl
gccaucucugcuucuugguuu

SEQ ID NO: 4426 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccaccacccuggugcugatt

SEQ ID NO: 4427 - RNA, 21 nt, Artificial Sequence
  Synthetic
  misc_feature (20)..(21): 2'-O-methyl
ucagcaccagggugguggcuu

SEQ ID NO: 4428 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccacuaauguccagcguutt

SEQ ID NO: 4429 - RNA, 21 nt, Artificial Sequence
  Synthetic
  misc_feature (20)..(21): 2'-O-methyl
aacgcuggacauuaguggguu

SEQ ID NO: 4430 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acuggcagcaacagucuuatt

SEQ ID NO: 4431 - RNA, 21 nt, Artificial Sequence
  Synthetic
  misc_feature (20)..(21): 2'-O-methyl
uaagacuguugcugccaguuu

SEQ ID NO: 4432 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggaacaugagaugggugtt

SEQ ID NO: 4433 - RNA, 21 nt, Artificial Sequence
  Synthetic
  misc_feature (20)..(21): 2'-O-methyl
cacccaucucauguuccauuu

SEQ ID NO: 4434 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucagaggacuaaauaccautt

SEQ ID NO: 4435 - RNA, 21 nt, Artificial Sequence
  Synthetic
  misc_feature (20)..(21): 2'-O-methyl
augguauuuaguccucugauu

SEQ ID NO: 4436 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugggaccuugcauaaccutt

SEQ ID NO: 4437 - RNA, 21 nt, Artificial Sequence
  Synthetic
  misc_feature (20)..(21): 2'-O-methyl
agguuaugcaaggucccaguu

SEQ ID NO: 4438 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucugaauaaaguguaacatt

SEQ ID NO: 4439 - RNA, 21 nt, Artificial Sequence
  Synthetic
  misc_feature (20)..(21): 2'-O-methyl
uguuacacuuuauucagauuu

SEQ ID NO: 4440 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccugccaucugugcucuutt

SEQ ID NO: 4441 - RNA, 21 nt, Artificial Sequence
  Synthetic
  misc_feature (20)..(21): 2'-O-methyl
aagagcacagauggcaggcuu

SEQ ID NO: 4442 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauuacaacucuccacaactt

SEQ ID NO: 4443 - RNA, 21 nt, Artificial Sequence
  Synthetic
  misc_feature (20)..(21): 2'-O-methyl
guuguggagaguuguaauguu

SEQ ID NO: 4444 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuccucagauggugucugctt

SEQ ID NO: 4445 - RNA, 21 nt, Artificial Sequence
  Synthetic
  misc_feature (20)..(21): 2'-O-methyl
gcagacaccaucugaggaguu

SEQ ID NO: 4446 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguugcuuguucgugcactt

SEQ ID NO: 4447 - RNA, 21 nt, Artificial Sequence
  Synthetic
  misc_feature (20)..(21): 2'-O-methyl
gugcacgaacaagcaacuguu

SEQ ID NO: 4448 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccugaggaagaggaugutt

SEQ ID NO: 4449 - RNA, 21 nt, Artificial Sequence
  Synthetic
  misc_feature (20)..(21): 2'-O-methyl
acauccucuuccucaggauuu

SEQ ID NO: 4450 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caccaguggauucuguguutt

SEQ ID NO: 4451 - RNA, 21 nt, Artificial Sequence
  Synthetic
  misc_feature (20)..(21): 2'-O-methyl
aacacagaauccacugguguu

SEQ ID NO: 4452 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagaaagcaagcucaucatt

SEQ ID NO: 4453 - RNA, 21 nt, Artificial Sequence
  Synthetic
  misc_feature (20)..(21): 2'-O-methyl
ugaugagcuugcuuucuuguu

SEQ ID NO: 4454 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuugcauaaccuuucccautt

SEQ ID NO: 4455 - RNA, 21 nt, Artificial Sequence
  Synthetic
  misc_feature (20)..(21): 2'-O-methyl
augggaaagguuaugcaaguu

SEQ ID NO: 4456 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuucacuauggacuaccagtt

SEQ ID NO: 4457 - RNA, 21 nt, Artificial Sequence
  Synthetic
  misc_feature (20)..(21): 2'-O-methyl
cugguaguccauagugaaguu

SEQ ID NO: 4458 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugcuuguucgugcacauctt

SEQ ID NO: 4459 - RNA, 21 nt, Artificial Sequence
  Synthetic
  misc_feature (20)..(21): 2'-O-methyl
gaugugcacgaacaagcaauu

SEQ ID NO: 4460 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauuguacguaccaugcagtt

SEQ ID NO: 4461 - RNA, 21 nt, Artificial Sequence
  Synthetic
  misc_feature (20)..(21): 2'-O-methyl
cugcaugguacguacaauauu

SEQ ID NO: 4462 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaugcagaauacaaaugatt

SEQ ID NO: 4463 - RNA, 21 nt, Artificial Sequence
  Synthetic
  misc_feature (20)..(21): 2'-O-methyl
ucauuuguauucugcaugguu

SEQ ID NO: 4464 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaaucuugcccuuugucctt

SEQ ID NO: 4465 - RNA, 21 nt, Artificial Sequence
  Synthetic
  misc_feature (20)..(21): 2'-O-methyl
ggacaaagggcaagauuucuu

SEQ ID NO: 4466 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucuugugcguacuguccutt

SEQ ID NO: 4467 - RNA, 21 nt, Artificial Sequence
  Synthetic
  misc_feature (20)..(21): 2'-O-methyl
aggacaguacgcacaagaguu

SEQ ID NO: 4468 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacaaccgaauuguuaucatt

SEQ ID NO: 4469 - RNA, 21 nt, Artificial Sequence
  Synthetic
  misc_feature (20)..(21): 2'-O-methyl
ugauaacaauucgguuguguu

SEQ ID NO: 4470 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuccucugacagaguuactt

SEQ ID NO: 4471 - RNA, 21 nt, Artificial Sequence
  Synthetic
  misc_feature (20)..(21): 2'-O-methyl
guaacucugucagaggagcuu

SEQ ID NO: 4472 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcguuuggcugaaccauctt

SEQ ID NO: 4473 - RNA, 21 nt, Artificial Sequence
  Synthetic
  misc_feature (20)..(21): 2'-O-methyl
gaugguucagccaaacgcuuu

SEQ ID NO: 4474 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caugcagaauacaaaugautt

SEQ ID NO: 4475 - RNA, 21 nt, Artificial Sequence
  Synthetic
  misc_feature (20)..(21): 2'-O-methyl
aucauuuguauucugcauguu

SEQ ID NO: 4476 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggauugauucgaaaucuutt

SEQ ID NO: 4477 - RNA, 21 nt, Artificial Sequence
  Synthetic
  misc_feature (20)..(21): 2'-O-methyl
aagauuucgaaucaauccauu

SEQ ID NO: 4478 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaacggcuuucaguugagctt

SEQ ID NO: 4479 - RNA, 21 nt, Artificial Sequence
  Synthetic
  misc_feature (20)..(21): 2'-O-methyl
gcucaacugaaagccguuuuu

SEQ ID NO: 4480 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuugucccgcaaaucaugctt

SEQ ID NO: 4481 - RNA, 21 nt, Artificial Sequence
  Synthetic
  misc_feature (20)..(21): 2'-O-methyl
gcaugauuugcgggacaaauu

SEQ ID NO: 4482 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucuaggaaugaagguguggtt

SEQ ID NO: 4483 - RNA, 21 nt, Artificial Sequence
  Synthetic
  misc_feature (20)..(21): 2'-O-methyl
ccacaccuucauuccuagauu

SEQ ID NO: 4484 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaguccuguaugagugggatt

SEQ ID NO: 4485 - RNA, 21 nt, Artificial Sequence
  Synthetic
  misc_feature (20)..(21): 2'-O-methyl
ucccacucauacaggacuuuu

SEQ ID NO: 4486 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguucaccaguggauucugtt

SEQ ID NO: 4487 - RNA, 21 nt, Artificial Sequence
  Synthetic
  misc_feature (20)..(21): 2'-O-methyl
cagaauccacuggugaaccuu

SEQ ID NO: 4488 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggucugccaaguggguggutt

SEQ ID NO: 4489 - RNA, 21 nt, Artificial Sequence
  Synthetic
  misc_feature (20)..(21): 2'-O-methyl
accacccacuuggcagaccuu

SEQ ID NO: 4490 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcuccucugacagaguuatt

SEQ ID NO: 4491 - RNA, 21 nt, Artificial Sequence
  Synthetic
  misc_feature (20)..(21): 2'-O-methyl
uaacucugucagaggagcuuu

SEQ ID NO: 4492 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucuggugccacuaccacatt

SEQ ID NO: 4493 - RNA, 21 nt, Artificial Sequence
  Synthetic
  misc_feature (20)..(21): 2'-O-methyl
ugugguaguggcaccagaauu

SEQ ID NO: 4494 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcuauguucccugagacatt

SEQ ID NO: 4495 - RNA, 21 nt, Artificial Sequence
  Synthetic
  misc_feature (20)..(21): 2'-O-methyl
ugucucagggaacauagcauu

SEQ ID NO: 4496 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auugauucgaaaucuugcctt

SEQ ID NO: 4497 - RNA, 21 nt, Artificial Sequence
  Synthetic
  misc_feature (20)..(21): 2'-O-methyl
ggcaagauuucgaaucaauuu

SEQ ID NO: 4498 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucauggaugggcugccuctt

SEQ ID NO: 4499 - RNA, 21 nt, Artificial Sequence
  Synthetic
  misc_feature (20)..(21): 2'-O-methyl
gaggcagcccauccaugaguu

SEQ ID NO: 4500 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugcuuuauucucccauutt

SEQ ID NO: 4501 - RNA, 21 nt, Artificial Sequence
  Synthetic
  misc_feature (20)..(21): 2'-O-methyl
aaugggagaauaaagcagcuu

SEQ ID NO: 4502 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucuuggcuauuacgacagtt

SEQ ID NO: 4503 - RNA, 21 nt, Artificial Sequence
  Synthetic
  misc_feature (20)..(21): 2'-O-methyl
cugucguaauagccaagaauu

SEQ ID NO: 4504 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucaugcaccuuugcgugatt

SEQ ID NO: 4505 - RNA, 21 nt, Artificial Sequence
  Synthetic
  misc_feature (20)..(21): 2'-O-methyl
ucacgcaaaggugcaugauuu

SEQ ID NO: 4506 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucacuggcagcaacaguctt

SEQ ID NO: 4507 - RNA, 21 nt, Artificial Sequence
  Synthetic
  misc_feature (20)..(21): 2'-O-methyl
gacuguugcugccagugacuu

SEQ ID NO: 4508 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugagugggaacagggauuutt

SEQ ID NO: 4509 - RNA, 21 nt, Artificial Sequence
  Synthetic
  misc_feature (20)..(21): 2'-O-methyl
aaaucccuguucccacucauu

SEQ ID NO: 4510 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauuauaagaacaagaugatt

SEQ ID NO: 4511 - RNA, 21 nt, Artificial Sequence
  Synthetic
  misc_feature (20)..(21): 2'-O-methyl
ucaucuuguucuuauaauuuu

SEQ ID NO: 4512 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggacaguuuaccaguugctt

SEQ ID NO: 4513 - RNA, 21 nt, Artificial Sequence
  Synthetic
  misc_feature (20)..(21): 2'-O-methyl
gcaacugguaaacuguccauu

SEQ ID NO: 4514 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augaggaccuauacuuacgtt

SEQ ID NO: 4515 - RNA, 21 nt, Artificial Sequence
  Synthetic
  misc_feature (20)..(21): 2'-O-methyl
cguaaguauagguccucauuu

SEQ ID NO: 4516 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaaggucuccuugggacutt

SEQ ID NO: 4517 - RNA, 21 nt, Artificial Sequence
  Synthetic
  misc_feature (20)..(21): 2'-O-methyl
agucccaaggagaccuuccuu

SEQ ID NO: 4518 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggaagaaauaguugaaggtt

SEQ ID NO: 4519 - RNA, 21 nt, Artificial Sequence
  Synthetic
  misc_feature (20)..(21): 2'-O-methyl
ccuucaacuauuucuuccauu

SEQ ID NO: 4520 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguguuauuuggaaccuugtt

SEQ ID NO: 4521 - RNA, 21 nt, Artificial Sequence
  Synthetic
  misc_feature (20)..(21): 2'-O-methyl
caagguuccaaauaacaccuu

SEQ ID NO: 4522 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gugcucuucgucaucugactt

SEQ ID NO: 4523 - RNA, 21 nt, Artificial Sequence
  Synthetic
  misc_feature (20)..(21): 2'-O-methyl
gucagaugacgaagagcacuu

SEQ ID NO: 4524 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggccauggaaccagacagatt

SEQ ID NO: 4525 - RNA, 21 nt, Artificial Sequence
  Synthetic
  misc_feature (20)..(21): 2'-O-methyl
ucugucugguuccauggccuu

SEQ ID NO: 4526 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cggcuguuagucacuggcatt

SEQ ID NO: 4527 - RNA, 21 nt, Artificial Sequence
  Synthetic
  misc_feature (20)..(21): 2'-O-methyl
ugccagugacuaacagccguu

SEQ ID NO: 4528 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuccacgacuaguucaguutt

SEQ ID NO: 4529 - RNA, 21 nt, Artificial Sequence
  Synthetic
  misc_feature (20)..(21): 2'-O-methyl
aacugaacuagucguggaauu

SEQ ID NO: 4530 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcagagauggcccagaautt

SEQ ID NO: 4531 - RNA, 21 nt, Artificial Sequence
  Synthetic
  misc_feature (20)..(21): 2'-O-methyl
auucugggccaucucugcuuu

SEQ ID NO: 4532 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccaggaugauccuagcuatt

SEQ ID NO: 4533 - RNA, 21 nt, Artificial Sequence
  Synthetic
  misc_feature (20)..(21): 2'-O-methyl
uagcuaggaucauccuggcuu

SEQ ID NO: 4534 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gccaucugugcucuucguctt

SEQ ID NO: 4535 - RNA, 21 nt, Artificial Sequence
  Synthetic
  misc_feature (20)..(21): 2'-O-methyl
gacgaagagcacagauggcuu

SEQ ID NO: 4536 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uagaaacagcucguuguactt

SEQ ID NO: 4537 - RNA, 21 nt, Artificial Sequence
  Synthetic
  misc_feature (20)..(21): 2'-O-methyl
guacaacgagcuguuucuauu

SEQ ID NO: 4538 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaugauggucugccaagutt

SEQ ID NO: 4539 - RNA, 21 nt, Artificial Sequence
  Synthetic
  misc_feature (20)..(21): 2'-O-methyl
acuuggcagaccaucaucuuu

SEQ ID NO: 4540 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accuuucccaucaucgugatt

SEQ ID NO: 4541 - RNA, 21 nt, Artificial Sequence
  Synthetic
  misc_feature (20)..(21): 2'-O-methyl
ucacgaugaugggaaagguuu

SEQ ID NO: 4542 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggaguuggacauggccatt

SEQ ID NO: 4543 - RNA, 21 nt, Artificial Sequence
  Synthetic
  misc_feature (20)..(21): 2'-O-methyl
uggccauguccaacuccauuu

SEQ ID NO: 4544 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugugcucuucgucaucugtt

SEQ ID NO: 4545 - RNA, 21 nt, Artificial Sequence
  Synthetic
  misc_feature (20)..(21): 2'-O-methyl
cagaugacgaagagcacaguu

SEQ ID NO: 4546 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauaagaacaagaugauggtt

SEQ ID NO: 4547 - RNA, 21 nt, Artificial Sequence
  Synthetic
  misc_feature (20)..(21): 2'-O-methyl
ccaucaucuuguucuuauauu

SEQ ID NO: 4548 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugaauaaaguguaacaatt

SEQ ID NO: 4549 - RNA, 21 nt, Artificial Sequence
  Synthetic
  misc_feature (20)..(21): 2'-O-methyl
uuguuacacuuuauucagauu

SEQ ID NO: 4550 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccagaaugcaguucgccuutt

SEQ ID NO: 4551 - RNA, 21 nt, Artificial Sequence
  Synthetic
  misc_feature (20)..(21): 2'-O-methyl
aaggcgaacugcauucugguu

SEQ ID NO: 4552 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaacaagaugauggucugtt

SEQ ID NO: 4553 - RNA, 21 nt, Artificial Sequence
  Synthetic
  misc_feature (20)..(21): 2'-O-methyl
cagaccaucaucuuguucuuu

SEQ ID NO: 4554 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucuugcccuuugucccgctt

SEQ ID NO: 4555 - RNA, 21 nt, Artificial Sequence
  Synthetic
  misc_feature (20)..(21): 2'-O-methyl
gcgggacaaagggcaagauuu

SEQ ID NO: 4556 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcguuuagcuggugggcugtt

SEQ ID NO: 4557 - RNA, 21 nt, Artificial Sequence
  Synthetic
  misc_feature (20)..(21): 2'-O-methyl
cagcccaccagcuaaacgcuu

SEQ ID NO: 4558 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggguucagaugauauaaautt

SEQ ID NO: 4559 - RNA, 21 nt, Artificial Sequence
  Synthetic
  misc_feature (20)..(21): 2'-O-methyl
auuuauaucaucugaacccuu

SEQ ID NO: 4560 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuuaggacuucaccugacatt

SEQ ID NO: 4561 - RNA, 21 nt, Artificial Sequence
  Synthetic
  misc_feature (20)..(21): 2'-O-methyl
ugucaggugaaguccuaaauu

SEQ ID NO: 4562 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacagcuccuucucugagutt

SEQ ID NO: 4563 - RNA, 21 nt, Artificial Sequence
  Synthetic
  misc_feature (20)..(21): 2'-O-methyl
acucagagaaggagcuguguu

SEQ ID NO: 4564 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacgucuuguucagaacugtt

SEQ ID NO: 4565 - RNA, 21 nt, Artificial Sequence
  Synthetic
  misc_feature (20)..(21): 2'-O-methyl
caguucugaacaagacguuuu

SEQ ID NO: 4566 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacagcagcaauuuguggatt

SEQ ID NO: 4567 - RNA, 21 nt, Artificial Sequence
  Synthetic
  misc_feature (20)..(21): 2'-O-methyl
uccacaaauugcugcuguguu

SEQ ID NO: 4568 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacuaguucaguugcuugutt

SEQ ID NO: 4569 - RNA, 21 nt, Artificial Sequence
  Synthetic
  misc_feature (20)..(21): 2'-O-methyl
acaagcaacugaacuagucuu

SEQ ID NO: 4570 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacagacugccuucaaauutt

SEQ ID NO: 4571 - RNA, 21 nt, Artificial Sequence
  Synthetic
  misc_feature (20)..(21): 2'-O-methyl
aauuugaaggcagucugucuu

SEQ ID NO: 4572 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucucucuucagaacagagtt

SEQ ID NO: 4573 - RNA, 21 nt, Artificial Sequence
  Synthetic
  misc_feature (20)..(21): 2'-O-methyl
cucuguucugaagagagaguu

SEQ ID NO: 4574 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guccagcguuuggcugaactt

SEQ ID NO: 4575 - RNA, 21 nt, Artificial Sequence
  Synthetic
  misc_feature (20)..(21): 2'-O-methyl
guucagccaaacgcuggacuu

SEQ ID NO: 4576 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugagggcaugcagaucccatt

SEQ ID NO: 4577 - RNA, 21 nt, Artificial Sequence
  Synthetic
  misc_feature (20)..(21): 2'-O-methyl
ugggaucugcaugcccucauu

SEQ ID NO: 4578 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaagaacaagaugaugguctt

SEQ ID NO: 4579 - RNA, 21 nt, Artificial Sequence
  Synthetic
  misc_feature (20)..(21): 2'-O-methyl
gaccaucaucuuguucuuauu

SEQ ID NO: 4580 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccaagucaacgucuuguutt

SEQ ID NO: 4581 - RNA, 21 nt, Artificial Sequence
  Synthetic
  misc_feature (20)..(21): 2'-O-methyl
aacaagacguugacuuggauu

SEQ ID NO: 4582 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaccaagaagcagagaugtt

SEQ ID NO: 4583 - RNA, 21 nt, Artificial Sequence
  Synthetic
  misc_feature (20)..(21): 2'-O-methyl
caucucugcuucuugguguuu

SEQ ID NO: 4584 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucaggaaucuuucagaugtt

SEQ ID NO: 4585 - RNA, 21 nt, Artificial Sequence
  Synthetic
  misc_feature (20)..(21): 2'-O-methyl
caucugaaagauuccugaguu

SEQ ID NO: 4586 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaauucuuggcuauuacgtt

SEQ ID NO: 4587 - RNA, 21 nt, Artificial Sequence
  Synthetic
  misc_feature (20)..(21): 2'-O-methyl
cguaauagccaagaauuuauu

SEQ ID NO: 4588 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuauggacuaccaguugugtt

SEQ ID NO: 4589 - RNA, 21 nt, Artificial Sequence
  Synthetic
  misc_feature (20)..(21): 2'-O-methyl
cacaacugguaguccauaguu

SEQ ID NO: 4590 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccagcguuuggcugaaccatt

SEQ ID NO: 4591 - RNA, 21 nt, Artificial Sequence
  Synthetic
  misc_feature (20)..(21): 2'-O-methyl
ugguucagccaaacgcugguu

SEQ ID NO: 4592 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucccaucaucgugagggcutt

SEQ ID NO: 4593 - RNA, 21 nt, Artificial Sequence
  Synthetic
  misc_feature (20)..(21): 2'-O-methyl
agcccucacgaugaugggauu

SEQ ID NO: 4594 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augagggcaugcagauccctt

SEQ ID NO: 4595 - RNA, 21 nt, Artificial Sequence
  Synthetic
  misc_feature (20)..(21): 2'-O-methyl
gggaucugcaugcccucauuu

SEQ ID NO: 4596 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggacuucaccugacagautt

SEQ ID NO: 4597 - RNA, 21 nt, Artificial Sequence
  Synthetic
  misc_feature (20)..(21): 2'-O-methyl
aucugucaggugaaguccuuu

SEQ ID NO: 4598 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugugcguacuguccuucgtt

SEQ ID NO: 4599 - RNA, 21 nt, Artificial Sequence
  Synthetic
  misc_feature (20)..(21): 2'-O-methyl
cgaaggacaguacgcacaauu

SEQ ID NO: 4600 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcuuccagacacgcuauctt

SEQ ID NO: 4601 - RNA, 21 nt, Artificial Sequence
  Synthetic
  misc_feature (20)..(21): 2'-O-methyl
gauagcgugucuggaagcuuu

SEQ ID NO: 4602 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaugggugggacacagcatt

SEQ ID NO: 4603 - RNA, 21 nt, Artificial Sequence
  Synthetic
  misc_feature (20)..(21): 2'-O-methyl
ugcugugucccacccaugguu

SEQ ID NO: 4604 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggauggaaggucuccuuggtt

SEQ ID NO: 4605 - RNA, 21 nt, Artificial Sequence
  Synthetic
  misc_feature (20)..(21): 2'-O-methyl
ccaaggagaccuuccauccuu

SEQ ID NO: 4606 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cccagcgccguacguccautt

SEQ ID NO: 4607 - RNA, 21 nt, Artificial Sequence
  Synthetic
  misc_feature (20)..(21): 2'-O-methyl
auggacguacggcgcuggguu

SEQ ID NO: 4608 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucagaggguacgagcugtt

SEQ ID NO: 4609 - RNA, 21 nt, Artificial Sequence
  Synthetic
  misc_feature (20)..(21): 2'-O-methyl
cagcucguacccucugagcuu

SEQ ID NO: 4610 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auguucacaaccgaauugutt

SEQ ID NO: 4611 - RNA, 21 nt, Artificial Sequence
  Synthetic
  misc_feature (20)..(21): 2'-O-methyl
acaauucgguugugaacauuu

SEQ ID NO: 4612 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcuuguucgugcacaucatt

SEQ ID NO: 4613 - RNA, 21 nt, Artificial Sequence
  Synthetic
  misc_feature (20)..(21): 2'-O-methyl
ugaugugcacgaacaagcauu

SEQ ID NO: 4614 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auguucccugagacauuagtt

SEQ ID NO: 4615 - RNA, 21 nt, Artificial Sequence
  Synthetic
  misc_feature (20)..(21): 2'-O-methyl
cuaaugucucagggaacauuu

SEQ ID NO: 4616 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaaaggcaauccugaggatt

SEQ ID NO: 4617 - RNA, 21 nt, Artificial Sequence
  Synthetic
  misc_feature (20)..(21): 2'-O-methyl
uccucaggauugccuuuacuu

SEQ ID NO: 4618 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacuggcagcaacagucuutt

SEQ ID NO: 4619 - RNA, 21 nt, Artificial Sequence
  Synthetic
  misc_feature (20)..(21): 2'-O-methyl
aagacuguugcugccaguguu

SEQ ID NO: 4620 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aucaugcguucuccucagatt

SEQ ID NO: 4621 - RNA, 21 nt, Artificial Sequence
  Synthetic
  misc_feature (20)..(21): 2'-O-methyl
ucugaggagaacgcaugauuu

SEQ ID NO: 4622 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauguauggguaggguaaatt

SEQ ID NO: 4623 - RNA, 21 nt, Artificial Sequence
  Synthetic
  misc_feature (20)..(21): 2'-O-methyl
uuuacccuacccauacauauu

SEQ ID NO: 4624 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guguuauuuggaaccuugutt

SEQ ID NO: 4625 - RNA, 21 nt, Artificial Sequence
  Synthetic
  misc_feature (20)..(21): 2'-O-methyl
acaagguuccaaauaacacuu

SEQ ID NO: 4626 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acagcuccucugacagagutt

SEQ ID NO: 4627 - RNA, 21 nt, Artificial Sequence
  Synthetic
  misc_feature (20)..(21): 2'-O-methyl
acucugucagaggagcuguuu

SEQ ID NO: 4628 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauggacuaccaguuguggtt

SEQ ID NO: 4629 - RNA, 21 nt, Artificial Sequence
  Synthetic
  misc_feature (20)..(21): 2'-O-methyl
ccacaacugguaguccauauu

SEQ ID NO: 4630 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auucuggugccacuaccactt

SEQ ID NO: 4631 - RNA, 21 nt, Artificial Sequence
  Synthetic
  misc_feature (20)..(21): 2'-O-methyl
gugguaguggcaccagaauuu

SEQ ID NO: 4632 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugccuccaggugacagcaatt

SEQ ID NO: 4633 - RNA, 21 nt, Artificial Sequence
  Synthetic
  misc_feature (20)..(21): 2'-O-methyl
uugcugucaccuggaggcauu

SEQ ID NO: 4634 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaccucccaaguccuguautt

SEQ ID NO: 4635 - RNA, 21 nt, Artificial Sequence
  Synthetic
  misc_feature (20)..(21): 2'-O-methyl
auacaggacuugggagguauu

SEQ ID NO: 4636 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccagacacgcuaucaugcgtt

SEQ ID NO: 4637 - RNA, 21 nt, Artificial Sequence
  Synthetic
  misc_feature (20)..(21): 2'-O-methyl
cgcaugauagcgugucugguu

SEQ ID NO: 4638 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugaugcagaacuugccacatt

SEQ ID NO: 4639 - RNA, 21 nt, Artificial Sequence
  Synthetic
  misc_feature (20)..(21): 2'-O-methyl
uguggcaaguucugcaucauu

SEQ ID NO: 4640 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuuagcuggugggcugcatt

SEQ ID NO: 4641 - RNA, 21 nt, Artificial Sequence
  Synthetic
  misc_feature (20)..(21): 2'-O-methyl
ugcagcccaccagcuaaacuu

SEQ ID NO: 4642 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gucugccaagugggugguatt

SEQ ID NO: 4643 - RNA, 21 nt, Artificial Sequence
  Synthetic
  misc_feature (20)..(21): 2'-O-methyl
uaccacccacuuggcagacuu

SEQ ID NO: 4644 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguuguaccggagcccuuctt

SEQ ID NO: 4645 - RNA, 21 nt, Artificial Sequence
  Synthetic
  misc_feature (20)..(21): 2'-O-methyl
gaagggcuccgguacaaccuu

SEQ ID NO: 4646 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guaccggagcccuucacautt

SEQ ID NO: 4647 - RNA, 21 nt, Artificial Sequence
  Synthetic
  misc_feature (20)..(21): 2'-O-methyl
augugaagggcuccgguacuu

SEQ ID NO: 4648 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caauccugaggaagaggautt

SEQ ID NO: 4649 - RNA, 21 nt, Artificial Sequence
  Synthetic
  misc_feature (20)..(21): 2'-O-methyl
auccucuuccucaggauuguu

SEQ ID NO: 4650 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuaucugucugcucuagutt

SEQ ID NO: 4651 - RNA, 21 nt, Artificial Sequence
  Synthetic
  misc_feature (20)..(21): 2'-O-methyl
acuagagcagacagauagcuu

SEQ ID NO: 4652 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugacagauccaagucaacgtt

SEQ ID NO: 4653 - RNA, 21 nt, Artificial Sequence
  Synthetic
  misc_feature (20)..(21): 2'-O-methyl
cguugacuuggaucugucauu

SEQ ID NO: 4654 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caugauggaacaugagaugtt

SEQ ID NO: 4655 - RNA, 21 nt, Artificial Sequence
  Synthetic
  misc_feature (20)..(21): 2'-O-methyl
caucucauguuccaucauguu

SEQ ID NO: 4656 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuggacucucaggaaucuutt

SEQ ID NO: 4657 - RNA, 21 nt, Artificial Sequence
  Synthetic
  misc_feature (20)..(21): 2'-O-methyl
aagauuccugagaguccaauu

SEQ ID NO: 4658 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cucuucgucaucugaccagtt

SEQ ID NO: 4659 - RNA, 21 nt, Artificial Sequence
  Synthetic
  misc_feature (20)..(21): 2'-O-methyl
cuggucagaugacgaagaguu

SEQ ID NO: 4660 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugcccuuugucccgcaaatt

SEQ ID NO: 4661 - RNA, 21 nt, Artificial Sequence
  Synthetic
  misc_feature (20)..(21): 2'-O-methyl
uuugcgggacaaagggcaauu

SEQ ID NO: 4662 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagcagagauggcccagatt

SEQ ID NO: 4663 - RNA, 21 nt, Artificial Sequence
  Synthetic
  misc_feature (20)..(21): 2'-O-methyl
ucugggccaucucugcuucuu

SEQ ID NO: 4664 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuugcauaaccuuucccatt

SEQ ID NO: 4665 - RNA, 21 nt, Artificial Sequence
  Synthetic
  misc_feature (20)..(21): 2'-O-methyl
ugggaaagguuaugcaagguu

SEQ ID NO: 4666 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caguuugaugcugcucauctt

SEQ ID NO: 4667 - RNA, 21 nt, Artificial Sequence
  Synthetic
  misc_feature (20)..(21): 2'-O-methyl
gaugagcagcaucaaacuguu

SEQ ID NO: 4668 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accugacagauccaagucatt

SEQ ID NO: 4669 - RNA, 21 nt, Artificial Sequence
  Synthetic
  misc_feature (20)..(21): 2'-O-methyl
ugacuuggaucugucagguuu

SEQ ID NO: 4670 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuuucagaugcugcaacuatt

SEQ ID NO: 4671 - RNA, 21 nt, Artificial Sequence
  Synthetic
  misc_feature (20)..(21): 2'-O-methyl
uaguugcagcaucugaaaguu

SEQ ID NO: 4672 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauacgaugcuucaagagatt

SEQ ID NO: 4673 - RNA, 21 nt, Artificial Sequence
  Synthetic
  misc_feature (20)..(21): 2'-O-methyl
ucucuugaagcaucguaucuu

SEQ ID NO: 4674 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augcaagcuuuaggacuuctt

SEQ ID NO: 4675 - RNA, 21 nt, Artificial Sequence
  Synthetic
  misc_feature (20)..(21): 2'-O-methyl
gaaguccuaaagcuugcauuu

SEQ ID NO: 4676 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggauguggauaccucccaatt

SEQ ID NO: 4677 - RNA, 21 nt, Artificial Sequence
  Synthetic
  misc_feature (20)..(21): 2'-O-methyl
uugggagguauccacauccuu

SEQ ID NO: 4678 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caggauacccagcgccguatt

SEQ ID NO: 4679 - RNA, 21 nt, Artificial Sequence
  Synthetic
  misc_feature (20)..(21): 2'-O-methyl
uacggcgcuggguauccuguu

SEQ ID NO: 4680 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaaugcaguucgccuucatt

SEQ ID NO: 4681 - RNA, 21 nt, Artificial Sequence
  Synthetic
  misc_feature (20)..(21): 2'-O-methyl
ugaaggcgaacugcauucuuu

SEQ ID NO: 4682 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acacgcuaucaugcguucutt

SEQ ID NO: 4683 - RNA, 21 nt, Artificial Sequence
  Synthetic
  misc_feature (20)..(21): 2'-O-methyl
agaacgcaugauagcguguuu

SEQ ID NO: 4684 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgaaaucuugcccuuuguctt

SEQ ID NO: 4685 - RNA, 21 nt, Artificial Sequence
  Synthetic
  misc_feature (20)..(21): 2'-O-methyl
gacaaagggcaagauuucguu

SEQ ID NO: 4686 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acucaagaacaaguagcugtt

SEQ ID NO: 4687 - RNA, 21 nt, Artificial Sequence
  Synthetic
  misc_feature (20)..(21): 2'-O-methyl
cagcuacuuguucuugaguuu

SEQ ID NO: 4688 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaugaagguguggcgacatt

SEQ ID NO: 4689 - RNA, 21 nt, Artificial Sequence
  Synthetic
  misc_feature (20)..(21): 2'-O-methyl
ugucgccacaccuucauucuu

SEQ ID NO: 4690 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcaccuuugcgugagcagtt

SEQ ID NO: 4691 - RNA, 21 nt, Artificial Sequence
  Synthetic
  misc_feature (20)..(21): 2'-O-methyl
cugcucacgcaaaggugcauu

SEQ ID NO: 4692 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acgagcugcuauguucccutt

SEQ ID NO: 4693 - RNA, 21 nt, Artificial Sequence
  Synthetic
  misc_feature (20)..(21): 2'-O-methyl
agggaacauagcagcucguuu

SEQ ID NO: 4694 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagaggauguggauaccuctt

SEQ ID NO: 4695 - RNA, 21 nt, Artificial Sequence
  Synthetic
  misc_feature (20)..(21): 2'-O-methyl
gagguauccacauccucuuuu

SEQ ID NO: 4696 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauauggccaggaugccuutt

SEQ ID NO: 4697 - RNA, 21 nt, Artificial Sequence
  Synthetic
  misc_feature (20)..(21): 2'-O-methyl
aaggcauccuggccauaucuu

SEQ ID NO: 4698 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauagaggcucuugugcgutt

SEQ ID NO: 4699 - RNA, 21 nt, Artificial Sequence
  Synthetic
  misc_feature (20)..(21): 2'-O-methyl
acgcacaagagccucuauauu

SEQ ID NO: 4700 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gguucagaugauauaaaugtt

SEQ ID NO: 4701 - RNA, 21 nt, Artificial Sequence
  Synthetic
  misc_feature (20)..(21): 2'-O-methyl
cauuuauaucaucugaaccuu

SEQ ID NO: 4702 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agggauggaaggucuccuutt

SEQ ID NO: 4703 - RNA, 21 nt, Artificial Sequence
  Synthetic
  misc_feature (20)..(21): 2'-O-methyl
aaggagaccuuccaucccuuu

SEQ ID NO: 4704 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaucccaaaguuguuguaatt

SEQ ID NO: 4705 - RNA, 21 nt, Artificial Sequence
  Synthetic
  misc_feature (20)..(21): 2'-O-methyl
uuacaacaacuuugggauauu

SEQ ID NO: 4706 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucucucuucagaacagagctt

SEQ ID NO: 4707 - RNA, 21 nt, Artificial Sequence
  Synthetic
  misc_feature (20)..(21): 2'-O-methyl
gcucuguucugaagagagauu

SEQ ID NO: 4708 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugaccagcucucucuucatt

SEQ ID NO: 4709 - RNA, 21 nt, Artificial Sequence
  Synthetic
  misc_feature (20)..(21): 2'-O-methyl
ugaagagagagcuggucaguu

SEQ ID NO: 4710 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
accugcugugauacgaugctt

SEQ ID NO: 4711 - RNA, 21 nt, Artificial Sequence
  Synthetic
  misc_feature (20)..(21): 2'-O-methyl
gcaucguaucacagcagguuu

SEQ ID NO: 4712 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auggcagugcguuuagcugtt

SEQ ID NO: 4713 - RNA, 21 nt, Artificial Sequence
  Synthetic
  misc_feature (20)..(21): 2'-O-methyl
cagcuaaacgcacugccauuu

SEQ ID NO: 4714 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auccaagucaacgucuugutt

SEQ ID NO: 4715 - RNA, 21 nt, Artificial Sequence
  Synthetic
  misc_feature (20)..(21): 2'-O-methyl
acaagacguugacuuggauuu

SEQ ID NO: 4716 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcugccuccaggugacagctt

SEQ ID NO: 4717 - RNA, 21 nt, Artificial Sequence
  Synthetic
  misc_feature (20)..(21): 2'-O-methyl
gcugucaccuggaggcagcuu

SEQ ID NO: 4718 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agugcguuuagcuggugggtt

SEQ ID NO: 4719 - RNA, 21 nt, Artificial Sequence
  Synthetic
  misc_feature (20)..(21): 2'-O-methyl
cccaccagcuaaacgcacuuu

SEQ ID NO: 4720 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agccggcuauuguagaagctt

SEQ ID NO: 4721 - RNA, 21 nt, Artificial Sequence
  Synthetic
  misc_feature (20)..(21): 2'-O-methyl
gcuucuacaauagccggcuuu

SEQ ID NO: 4722 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugugcucuucgucaucutt

SEQ ID NO: 4723 - RNA, 21 nt, Artificial Sequence
  Synthetic
  misc_feature (20)..(21): 2'-O-methyl
agaugacgaagagcacagauu

SEQ ID NO: 4724 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacaagauuacaagaaacgtt

SEQ ID NO: 4725 - RNA, 21 nt, Artificial Sequence
  Synthetic
  misc_feature (20)..(21): 2'-O-methyl
cguuucuuguaaucuuguguu

SEQ ID NO: 4726 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauggaacaugagaugggutt

SEQ ID NO: 4727 - RNA, 21 nt, Artificial Sequence
  Synthetic
  misc_feature (20)..(21): 2'-O-methyl
acccaucucauguuccaucuu

SEQ ID NO: 4728 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauuagaugagggcaugcatt

SEQ ID NO: 4729 - RNA, 21 nt, Artificial Sequence
  Synthetic
  misc_feature (20)..(21): 2'-O-methyl
ugcaugcccucaucuaauguu

SEQ ID NO: 4730 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagguguggcgacauaugtt

SEQ ID NO: 4731 - RNA, 21 nt, Artificial Sequence
  Synthetic
  misc_feature (20)..(21): 2'-O-methyl
cauaugucgccacaccuucuu

SEQ ID NO: 4732 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagugggugguauagaggctt

SEQ ID NO: 4733 - RNA, 21 nt, Artificial Sequence
  Synthetic
  misc_feature (20)..(21): 2'-O-methyl
gccucuauaccacccacuuuu

SEQ ID NO: 4734 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugagggagccacagcucctt

SEQ ID NO: 4735 - RNA, 21 nt, Artificial Sequence
  Synthetic
  misc_feature (20)..(21): 2'-O-methyl
ggagcuguggcucccucaguu

SEQ ID NO: 4736 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcguuuggcugaaccaucatt

SEQ ID NO: 4737 - RNA, 21 nt, Artificial Sequence
  Synthetic
  misc_feature (20)..(21): 2'-O-methyl
ugaugguucagccaaacgcuu

SEQ ID NO: 4738 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccuucucugagugguaaatt

SEQ ID NO: 4739 - RNA, 21 nt, Artificial Sequence
  Synthetic
  misc_feature (20)..(21): 2'-O-methyl
uuuaccacucagagaaggauu

SEQ ID NO: 4740 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaguucgccuucacuaugtt

SEQ ID NO: 4741 - RNA, 21 nt, Artificial Sequence
  Synthetic
  misc_feature (20)..(21): 2'-O-methyl
cauagugaaggcgaacugcuu

SEQ ID NO: 4742 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggacucucaggaaucuuutt

SEQ ID NO: 4743 - RNA, 21 nt, Artificial Sequence
  Synthetic
  misc_feature (20)..(21): 2'-O-methyl
aaagauuccugagaguccauu

SEQ ID NO: 4744 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuuggacucucaggaaucutt

SEQ ID NO: 4745 - RNA, 21 nt, Artificial Sequence
  Synthetic
  misc_feature (20)..(21): 2'-O-methyl
agauuccugagaguccaaauu

SEQ ID NO: 4746 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaugccuuggguauggatt

SEQ ID NO: 4747 - RNA, 21 nt, Artificial Sequence
  Synthetic
  misc_feature (20)..(21): 2'-O-methyl
uccauacccaaggcauccuuu

SEQ ID NO: 4748 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cugagacauuagaugagggtt

SEQ ID NO: 4749 - RNA, 21 nt, Artificial Sequence
  Synthetic
  misc_feature (20)..(21): 2'-O-methyl
cccucaucuaaugucucaguu

SEQ ID NO: 4750 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucagaugauauaaaugugtt

SEQ ID NO: 4751 - RNA, 21 nt, Artificial Sequence
  Synthetic
  misc_feature (20)..(21): 2'-O-methyl
cacauuuauaucaucugaauu

SEQ ID NO: 4752 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacuugauauuggugccctt

SEQ ID NO: 4753 - RNA, 21 nt, Artificial Sequence
  Synthetic
  misc_feature (20)..(21): 2'-O-methyl
gggcaccaauaucaaguccuu

SEQ ID NO: 4754 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuuggcugaaccaucacatt

SEQ ID NO: 4755 - RNA, 21 nt, Artificial Sequence
  Synthetic
  misc_feature (20)..(21): 2'-O-methyl
ugugaugguucagccaaacuu

SEQ ID NO: 4756 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcaugcagaucccaucuactt

SEQ ID NO: 4757 - RNA, 21 nt, Artificial Sequence
  Synthetic
  misc_feature (20)..(21): 2'-O-methyl
guagaugggaucugcaugcuu

SEQ ID NO: 4758 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaugggcugccagaucuggtt

SEQ ID NO: 4759 - RNA, 21 nt, Artificial Sequence
  Synthetic
  misc_feature (20)..(21): 2'-O-methyl
ccagaucuggcagcccaucuu

SEQ ID NO: 4760 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacuucaccugacagauctt

SEQ ID NO: 4761 - RNA, 21 nt, Artificial Sequence
  Synthetic
  misc_feature (20)..(21): 2'-O-methyl
gaucugucaggugaaguccuu

SEQ ID NO: 4762 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caacgucuuguucagaacutt

SEQ ID NO: 4763 - RNA, 21 nt, Artificial Sequence
  Synthetic
  misc_feature (20)..(21): 2'-O-methyl
aguucugaacaagacguuguu

SEQ ID NO: 4764 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gauauugauggacaguaugtt

SEQ ID NO: 4765 - RNA, 21 nt, Artificial Sequence
  Synthetic
  misc_feature (20)..(21): 2'-O-methyl
cauacuguccaucaauaucuu

SEQ ID NO: 4766 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggccauggaaccagacagtt

SEQ ID NO: 4767 - RNA, 21 nt, Artificial Sequence
  Synthetic
  misc_feature (20)..(21): 2'-O-methyl
cugucugguuccauggccauu

SEQ ID NO: 4768 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagaacaaguagcugauatt

SEQ ID NO: 4769 - RNA, 21 nt, Artificial Sequence
  Synthetic
  misc_feature (20)..(21): 2'-O-methyl
uaucagcuacuuguucuuguu

SEQ ID NO: 4770 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggcuguuagucacuggcagtt

SEQ ID NO: 4771 - RNA, 21 nt, Artificial Sequence
  Synthetic
  misc_feature (20)..(21): 2'-O-methyl
cugccagugacuaacagccuu

SEQ ID NO: 4772 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cauuguuugugcagcugcutt

SEQ ID NO: 4773 - RNA, 21 nt, Artificial Sequence
  Synthetic
  misc_feature (20)..(21): 2'-O-methyl
agcagcugcacaaacaauguu

SEQ ID NO: 4774 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaaacaggaagggauggaatt

SEQ ID NO: 4775 - RNA, 21 nt, Artificial Sequence
  Synthetic
  misc_feature (20)..(21): 2'-O-methyl
uuccaucccuuccuguuuauu

SEQ ID NO: 4776 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaagaacaagaugauggutt

SEQ ID NO: 4777 - RNA, 21 nt, Artificial Sequence
  Synthetic
  misc_feature (20)..(21): 2'-O-methyl
accaucaucuuguucuuauuu

SEQ ID NO: 4778 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guggaaugcaagcuuuaggtt

SEQ ID NO: 4779 - RNA, 21 nt, Artificial Sequence
  Synthetic
  misc_feature (20)..(21): 2'-O-methyl
ccuaaagcuugcauuccacuu

SEQ ID NO: 4780 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggaaugaagguguggcgactt

SEQ ID NO: 4781 - RNA, 21 nt, Artificial Sequence
  Synthetic
  misc_feature (20)..(21): 2'-O-methyl
gucgccacaccuucauuccuu

SEQ ID NO: 4782 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gacaccaagaagcagagautt

SEQ ID NO: 4783 - RNA, 21 nt, Artificial Sequence
  Synthetic
  misc_feature (20)..(21): 2'-O-methyl
aucucugcuucuuggugucuu

SEQ ID NO: 4784 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acugucuuuggacucucagtt

SEQ ID NO: 4785 - RNA, 21 nt, Artificial Sequence
  Synthetic
  misc_feature (20)..(21): 2'-O-methyl
cugagaguccaaagacaguuu

SEQ ID NO: 4786 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ggacaaggaagcugcagaatt

SEQ ID NO: 4787 - RNA, 21 nt, Artificial Sequence
  Synthetic
  misc_feature (20)..(21): 2'-O-methyl
uucugcagcuuccuuguccuu

SEQ ID NO: 4788 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucugcuauuguacguaccatt

SEQ ID NO: 4789 - RNA, 21 nt, Artificial Sequence
  Synthetic
  misc_feature (20)..(21): 2'-O-methyl
ugguacguacaauagcagauu

SEQ ID NO: 4790 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcugcuuuauucucccautt

SEQ ID NO: 4791 - RNA, 21 nt, Artificial Sequence
  Synthetic
  misc_feature (20)..(21): 2'-O-methyl
augggagaauaaagcagcuuu

SEQ ID NO: 4792 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggguacgagcugcuaugutt

SEQ ID NO: 4793 - RNA, 21 nt, Artificial Sequence
  Synthetic
  misc_feature (20)..(21): 2'-O-methyl
acauagcagcucguacccuuu

SEQ ID NO: 4794 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaagacaucacugagccugtt

SEQ ID NO: 4795 - RNA, 21 nt, Artificial Sequence
  Synthetic
  misc_feature (20)..(21): 2'-O-methyl
caggcucagugaugucuucuu

SEQ ID NO: 4796 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgggauguucacaaccgaatt

SEQ ID NO: 4797 - RNA, 21 nt, Artificial Sequence
  Synthetic
  misc_feature (20)..(21): 2'-O-methyl
uucgguugugaacaucccguu

SEQ ID NO: 4798 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagccgacaccaagaagcatt

SEQ ID NO: 4799 - RNA, 21 nt, Artificial Sequence
  Synthetic
  misc_feature (20)..(21): 2'-O-methyl
ugcuucuuggugucggcuguu

SEQ ID NO: 4800 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
acaguaugcaaugacucgatt

SEQ ID NO: 4801 - RNA, 21 nt, Artificial Sequence
  Synthetic
  misc_feature (20)..(21): 2'-O-methyl
ucgagucauugcauacuguuu

SEQ ID NO: 4802 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agaaauaguugaagguugutt

SEQ ID NO: 4803 - RNA, 21 nt, Artificial Sequence
  Synthetic
  misc_feature (20)..(21): 2'-O-methyl
acaaccuucaacuauuucuuu

SEQ ID NO: 4804 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uguucacaaccgaauuguutt

SEQ ID NO: 4805 - RNA, 21 nt, Artificial Sequence
  Synthetic
  misc_feature (20)..(21): 2'-O-methyl
aacaauucgguugugaacauu

SEQ ID NO: 4806 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcucucucuucagaacagatt

SEQ ID NO: 4807 - RNA, 21 nt, Artificial Sequence
  Synthetic
  misc_feature (20)..(21): 2'-O-methyl
ucuguucugaagagagagcuu

SEQ ID NO: 4808 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucagauggugucugcuauutt

SEQ ID NO: 4809 - RNA, 21 nt, Artificial Sequence
  Synthetic
  misc_feature (20)..(21): 2'-O-methyl
aauagcagacaccaucugauu

SEQ ID NO: 4810 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugagugguaaaggcaaucctt

SEQ ID NO: 4811 - RNA, 21 nt, Artificial Sequence
  Synthetic
  misc_feature (20)..(21): 2'-O-methyl
ggauugccuuuaccacucauu

SEQ ID NO: 4812 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uggugccacuaccacagcutt

SEQ ID NO: 4813 - RNA, 21 nt, Artificial Sequence
  Synthetic
  misc_feature (20)..(21): 2'-O-methyl
agcugugguaguggcaccauu

SEQ ID NO: 4814 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uugucccgcaaaucaugcatt

SEQ ID NO: 4815 - RNA, 21 nt, Artificial Sequence
  Synthetic
  misc_feature (20)..(21): 2'-O-methyl
ugcaugauuugcgggacaauu

SEQ ID NO: 4816 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacccuggugcugacuauctt

SEQ ID NO: 4817 - RNA, 21 nt, Artificial Sequence
  Synthetic
  misc_feature (20)..(21): 2'-O-methyl
gauagucagcaccaggguguu

SEQ ID NO: 4818 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aauguccagcguuuggcugtt

SEQ ID NO: 4819 - RNA, 21 nt, Artificial Sequence
  Synthetic
  misc_feature (20)..(21): 2'-O-methyl
cagccaaacgcuggacauuuu

SEQ ID NO: 4820 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggcugccuccaggugacatt

SEQ ID NO: 4821 - RNA, 21 nt, Artificial Sequence
  Synthetic
  misc_feature (20)..(21): 2'-O-methyl
ugucaccuggaggcagcccuu

SEQ ID NO: 4822 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaguuacuucacucuaggatt

SEQ ID NO: 4823 - RNA, 21 nt, Artificial Sequence
  Synthetic
  misc_feature (20)..(21): 2'-O-methyl
uccuagagugaaguaacucuu

SEQ ID NO: 4824 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uucgaaaucuugcccuuugtt

SEQ ID NO: 4825 - RNA, 21 nt, Artificial Sequence
  Synthetic
  misc_feature (20)..(21): 2'-O-methyl
caaagggcaagauuucgaauu

SEQ ID NO: 4826 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guauagaggcucuugugcgtt

SEQ ID NO: 4827 - RNA, 21 nt, Artificial Sequence
  Synthetic
  misc_feature (20)..(21): 2'-O-methyl
cgcacaagagccucuauacuu

SEQ ID NO: 4828 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcugaccagcucucucuutt

SEQ ID NO: 4829 - RNA, 21 nt, Artificial Sequence
  Synthetic
  misc_feature (20)..(21): 2'-O-methyl
aagagagagcuggucagcuuu

SEQ ID NO: 4830 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cuauuguacguaccaugcatt

SEQ ID NO: 4831 - RNA, 21 nt, Artificial Sequence
  Synthetic
  misc_feature (20)..(21): 2'-O-methyl
ugcaugguacguacaauaguu

SEQ ID NO: 4832 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaugcaaugacucgagcuctt

SEQ ID NO: 4833 - RNA, 21 nt, Artificial Sequence
  Synthetic
  misc_feature (20)..(21): 2'-O-methyl
gagcucgagucauugcauauu

SEQ ID NO: 4834 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcccaggaccucauggautt

SEQ ID NO: 4835 - RNA, 21 nt, Artificial Sequence
  Synthetic
  misc_feature (20)..(21): 2'-O-methyl
auccaugagguccugggcauu

SEQ ID NO: 4836 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aacaaguagcugauauugatt

SEQ ID NO: 4837 - RNA, 21 nt, Artificial Sequence
  Synthetic
  misc_feature (20)..(21): 2'-O-methyl
ucaauaucagcuacuuguuuu

SEQ ID NO: 4838 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaggcaauccugaggaagatt

SEQ ID NO: 4839 - RNA, 21 nt, Artificial Sequence
  Synthetic
  misc_feature (20)..(21): 2'-O-methyl
ucuuccucaggauugccuuuu

SEQ ID NO: 4840 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
caagaugauggucugccaatt

SEQ ID NO: 4841 - RNA, 21 nt, Artificial Sequence
  Synthetic
  misc_feature (20)..(21): 2'-O-methyl
uuggcagaccaucaucuuguu

SEQ ID NO: 4842 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugccauuacaacucuccactt

SEQ ID NO: 4843 - RNA, 21 nt, Artificial Sequence
  Synthetic
  misc_feature (20)..(21): 2'-O-methyl
guggagaguuguaauggcauu

SEQ ID NO: 4844 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagauccaagucaacgucutt

SEQ ID NO: 4845 - RNA, 21 nt, Artificial Sequence
  Synthetic
  misc_feature (20)..(21): 2'-O-methyl
agacguugacuuggaucuguu

SEQ ID NO: 4846 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auguauggguaggguaaautt

SEQ ID NO: 4847 - RNA, 21 nt, Artificial Sequence
  Synthetic
  misc_feature (20)..(21): 2'-O-methyl
auuuacccuacccauacauuu

SEQ ID NO: 4848 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugugcucuucgucaucugatt

SEQ ID NO: 4849 - RNA, 21 nt, Artificial Sequence
  Synthetic
  misc_feature (20)..(21): 2'-O-methyl
ucagaugacgaagagcacauu

SEQ ID NO: 4850 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaggcuacuguuggauugatt

SEQ ID NO: 4851 - RNA, 21 nt, Artificial Sequence
  Synthetic
  misc_feature (20)..(21): 2'-O-methyl
ucaauccaacaguagccuuuu

SEQ ID NO: 4852 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uacuguccuucgggcuggutt

SEQ ID NO: 4853 - RNA, 21 nt, Artificial Sequence
  Synthetic
  misc_feature (20)..(21): 2'-O-methyl
accagcccgaaggacaguauu

SEQ ID NO: 4854 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auaaggcugcaguuauggutt

SEQ ID NO: 4855 - RNA, 21 nt, Artificial Sequence
  Synthetic
  misc_feature (20)..(21): 2'-O-methyl
accauaacugcagccuuauuu

SEQ ID NO: 4856 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucgucaucugaccagccgatt

SEQ ID NO: 4857 - RNA, 21 nt, Artificial Sequence
  Synthetic
  misc_feature (20)..(21): 2'-O-methyl
ucggcuggucagaugacgauu

SEQ ID NO: 4858 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guuguaaccugcugugauatt

SEQ ID NO: 4859 - RNA, 21 nt, Artificial Sequence
  Synthetic
  misc_feature (20)..(21): 2'-O-methyl
uaucacagcagguuacaacuu

SEQ ID NO: 4860 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aagauuacaagaaacggcutt

SEQ ID NO: 4861 - RNA, 21 nt, Artificial Sequence
  Synthetic
  misc_feature (20)..(21): 2'-O-methyl
agccguuucuuguaaucuuuu

SEQ ID NO: 4862 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uuauggcaaccaagaaagctt

SEQ ID NO: 4863 - RNA, 21 nt, Artificial Sequence
  Synthetic
  misc_feature (20)..(21): 2'-O-methyl
gcuuucuugguugccauaauu

SEQ ID NO: 4864 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uccaguugaugggcugccatt

SEQ ID NO: 4865 - RNA, 21 nt, Artificial Sequence
  Synthetic
  misc_feature (20)..(21): 2'-O-methyl
uggcagcccaucaacuggauu

SEQ ID NO: 4866 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccugugcagcuggaauucutt

SEQ ID NO: 4867 - RNA, 21 nt, Artificial Sequence
  Synthetic
  misc_feature (20)..(21): 2'-O-methyl
agaauuccagcugcacagguu

SEQ ID NO: 4868 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggacacagcagcaauuugtt

SEQ ID NO: 4869 - RNA, 21 nt, Artificial Sequence
  Synthetic
  misc_feature (20)..(21): 2'-O-methyl
caaauugcugcugugucccuu

SEQ ID NO: 4870 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augauggaacaugagauggtt

SEQ ID NO: 4871 - RNA, 21 nt, Artificial Sequence
  Synthetic
  misc_feature (20)..(21): 2'-O-methyl
ccaucucauguuccaucauuu

SEQ ID NO: 4872 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uauuugggauauguaugggtt

SEQ ID NO: 4873 - RNA, 21 nt, Artificial Sequence
  Synthetic
  misc_feature (20)..(21): 2'-O-methyl
cccauacauaucccaaauauu

SEQ ID NO: 4874 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cagcugcuuuauucucccatt

SEQ ID NO: 4875 - RNA, 21 nt, Artificial Sequence
  Synthetic
  misc_feature (20)..(21): 2'-O-methyl
ugggagaauaaagcagcuguu

SEQ ID NO: 4876 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gcuacucaagcugauuugatt

SEQ ID NO: 4877 - RNA, 21 nt, Artificial Sequence
  Synthetic
  misc_feature (20)..(21): 2'-O-methyl
ucaaaucagcuugaguagcuu

SEQ ID NO: 4878 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ucccugagacauuagaugatt

SEQ ID NO: 4879 - RNA, 21 nt, Artificial Sequence
  Synthetic
  misc_feature (20)..(21): 2'-O-methyl
ucaucuaaugucucagggauu

SEQ ID NO: 4880 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
guggauaccucccaagucctt

SEQ ID NO: 4881 - RNA, 21 nt, Artificial Sequence
  Synthetic
  misc_feature (20)..(21): 2'-O-methyl
ggacuugggagguauccacuu

SEQ ID NO: 4882 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
uaggaaugaagguguggcgtt

SEQ ID NO: 4883 - RNA, 21 nt, Artificial Sequence
  Synthetic
  misc_feature (20)..(21): 2'-O-methyl
cgccacaccuucauuccuauu

SEQ ID NO: 4884 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugacagaguuacuucacuctt

SEQ ID NO: 4885 - RNA, 21 nt, Artificial Sequence
  Synthetic
  misc_feature (20)..(21): 2'-O-methyl
gagugaaguaacucugucauu

SEQ ID NO: 4886 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
agcggcuguuagucacuggtt

SEQ ID NO: 4887 - RNA, 21 nt, Artificial Sequence
  Synthetic
  misc_feature (20)..(21): 2'-O-methyl
ccagugacuaacagccgcuuu

SEQ ID NO: 4888 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augguucagaauuaaacuutt

SEQ ID NO: 4889 - RNA, 21 nt, Artificial Sequence
  Synthetic
  misc_feature (20)..(21): 2'-O-methyl
aaguuuaauucugaaccauuu

SEQ ID NO: 4890 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aaccgaauuguuaucagagtt

SEQ ID NO: 4891 - RNA, 21 nt, Artificial Sequence
  Synthetic
  misc_feature (20)..(21): 2'-O-methyl
cucugauaacaauucgguuuu

SEQ ID NO: 4892 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggugccauuccacgacuatt

SEQ ID NO: 4893 - RNA, 21 nt, Artificial Sequence
  Synthetic
  misc_feature (20)..(21): 2'-O-methyl
uagucguggaauggcacccuu

SEQ ID NO: 4894 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
augauggucugccaaguggtt

SEQ ID NO: 4895 - RNA, 21 nt, Artificial Sequence
  Synthetic
  misc_feature (20)..(21): 2'-O-methyl
ccacuuggcagaccaucauuu

SEQ ID NO: 4896 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gggaagacaucacugagcctt

SEQ ID NO: 4897 - RNA, 21 nt, Artificial Sequence
  Synthetic
  misc_feature (20)..(21): 2'-O-methyl
ggcucagugaugucuucccuu

SEQ ID NO: 4898 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cacaucaggauacccagcgtt

SEQ ID NO: 4899 - RNA, 21 nt, Artificial Sequence
  Synthetic
  misc_feature (20)..(21): 2'-O-methyl
cgcuggguauccugauguguu

SEQ ID NO: 4900 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
aggaaugaagguguggcgatt

SEQ ID NO: 4901 - RNA, 21 nt, Artificial Sequence
  Synthetic
  misc_feature (20)..(21): 2'-O-methyl
ucgccacaccuucauuccuuu

SEQ ID NO: 4902 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
gaaggugcuaucugucugctt

SEQ ID NO: 4903 - RNA, 21 nt, Artificial Sequence
  Synthetic
  misc_feature (20)..(21): 2'-O-methyl
gcagacagauagcaccuucuu

SEQ ID NO: 4904 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccaagaaagcaagcucauctt

SEQ ID NO: 4905 - RNA, 21 nt, Artificial Sequence
  Synthetic
  misc_feature (20)..(21): 2'-O-methyl
gaugagcuugcuuucuugguu

SEQ ID NO: 4906 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
cgagcugcuauguucccugtt

SEQ ID NO: 4907 - RNA, 21 nt, Artificial Sequence
  Synthetic
  misc_feature (20)..(21): 2'-O-methyl
cagggaacauagcagcucguu

SEQ ID NO: 4908 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ccuggugcugacuauccagtt

SEQ ID NO: 4909 - RNA, 21 nt, Artificial Sequence
  Synthetic
  misc_feature (20)..(21): 2'-O-methyl
cuggauagucagcaccagguu

SEQ ID NO: 4910 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
ugcuaucugucugcucuagtt

SEQ ID NO: 4911 - RNA, 21 nt, Artificial Sequence
  Synthetic
  misc_feature (20)..(21): 2'-O-methyl
cuagagcagacagauagcauu

SEQ ID NO: 4912 - DNA, 21 bp, Artificial Sequence
  Synthetic
  misc_feature (1)..(19): ribonucleotide unmodified or modified as described for this sequence
  misc_feature (1)..(1): inverted abasic cap
  misc_feature (21)..(21): inverted abasic cap
auuguagaagcugguggaatt

SEQ ID NO: 4913 - RNA, 21 nt, Artificial Sequence
  Synthetic
  misc_feature (20)..(21): 2'-O-methyl
uuccaccagcuucuacaauuu

SEQ ID NO: 4914 - RNA, 19 nt, Artificial Sequence
  Synthetic
ucguacccucugagcucga

SEQ ID NO: 4915 - RNA, 19 nt, Artificial Sequence
  Synthetic
caguacgcacaagagccuc

SEQ ID NO: 4916 - RNA, 19 nt, Artificial Sequence
  Synthetic
ggcgaacugcauucugggc

SEQ ID NO: 4917 - RNA, 19 nt, Artificial Sequence
  Synthetic
cucguacccucugagcucg

SEQ ID NO: 4918 - RNA, 19 nt, Artificial Sequence
  Synthetic
uuucgaaucaauccaacag

SEQ ID NO: 4919 - RNA, 19 nt, Artificial Sequence
  Synthetic
gguacguacaauagcagac

SEQ ID NO: 4920 - RNA, 19 nt, Artificial Sequence
  Synthetic
gucguaauagccaagaauu

SEQ ID NO: 4921 - RNA, 19 nt, Artificial Sequence
  Synthetic
aauucgguugugaacaucc

SEQ ID NO: 4922 - RNA, 19 nt, Artificial Sequence
  Synthetic
ucgagucauugcauacugu

SEQ ID NO: 4923 - RNA, 19 nt, Artificial Sequence
  Synthetic
gauagcgugucuggaagcu

SEQ ID NO: 4924 - RNA, 19 nt, Artificial Sequence
  Synthetic
guacguacaauagcagaca

SEQ ID NO: 4925 - RNA, 19 nt, Artificial Sequence
  Synthetic
uucgaaucaauccaacagu

SEQ ID NO: 4926 - RNA, 19 nt, Artificial Sequence
  Synthetic
uacggcgcuggguauccug

SEQ ID NO: 4927 - RNA, 19 nt, Artificial Sequence
  Synthetic
gaacgcaugauagcguguc

SEQ ID NO: 4928 - RNA, 19 nt, Artificial Sequence
  Synthetic
ucgaaucaauccaacagua

SEQ ID NO: 4929 - RNA, 19 nt, Artificial Sequence
  Synthetic
cugucguaauagccaagaa

SEQ ID NO: 4930 - RNA, 19 nt, Artificial Sequence
  Synthetic
agaacgcaugauagcgugu

SEQ ID NO: 4931 - RNA, 19 nt, Artificial Sequence
  Synthetic
acgcaugauagcgugucug

SEQ ID NO: 4932 - RNA, 19 nt, Artificial Sequence
  Synthetic
auuucgaaucaauccaaca

SEQ ID NO: 4933 - RNA, 19 nt, Artificial Sequence
  Synthetic
agacguugacuuggaucug

SEQ ID NO: 4934 - RNA, 19 nt, Artificial Sequence
  Synthetic
acaguacgcacaagagccu

SEQ ID NO: 4935 - RNA, 19 nt, Artificial Sequence
  Synthetic
agcccgaaggacaguacgc

SEQ ID NO: 4936 - RNA, 19 nt, Artificial Sequence
  Synthetic
ccaaacgcuggacauuagu

SEQ ID NO: 4937 - RNA, 19 nt, Artificial Sequence
  Synthetic
caucccgagcuaggaugug

SEQ ID NO: 4938 - RNA, 19 nt, Artificial Sequence
  Synthetic
cucgagcccucucagcaac

SEQ ID NO: 4939 - RNA, 19 nt, Artificial Sequence
  Synthetic
ggugucggcuggucagaug

SEQ ID NO: 4940 - RNA, 19 nt, Artificial Sequence
  Synthetic
gcccgaaggacaguacgca

SEQ ID NO: 4941 - RNA, 19 nt, Artificial Sequence
  Synthetic
ccguuucuuguaaucuugu

SEQ ID NO: 4942 - RNA, 19 nt, Artificial Sequence
  Synthetic
aguuaaucaaguuuacaac

SEQ ID NO: 4943 - RNA, 19 nt, Artificial Sequence
  Synthetic
ugauaguuaaucaaguuua

SEQ ID NO: 4944 - RNA, 19 nt, Artificial Sequence
  Synthetic
guauagguccucauuauau

SEQ ID NO: 4945 - RNA, 19 nt, Artificial Sequence
  Synthetic
uugauaguuaaucaaguuu

SEQ ID NO: 4946 - RNA, 19 nt, Artificial Sequence
  Synthetic
uacaaccuucaacuauuuc

SEQ ID NO: 4947 - RNA, 19 nt, Artificial Sequence
  Synthetic
aaguauagguccucauuau

SEQ ID NO: 4948 - RNA, 19 nt, Artificial Sequence
  Synthetic
guaauagccaagaauuuaa

SEQ ID NO: 4949 - RNA, 19 nt, Artificial Sequence
  Synthetic
auaguuaaucaaguuuaca

SEQ ID NO: 4950 - RNA, 19 nt, Artificial Sequence
  Synthetic
gauaguuaaucaaguuuac

SEQ ID NO: 4951 - RNA, 19 nt, Artificial Sequence
  Synthetic
uaguuaaucaaguuuacaa

SEQ ID NO: 4952 - RNA, 19 nt, Artificial Sequence
  Synthetic
ucauuauauuuacuaaagc

SEQ ID NO: 4953 - RNA, 19 nt, Artificial Sequence
  Synthetic
agcaccagggugguggcca

SEQ ID NO: 4954 - RNA, 19 nt, Artificial Sequence
  Synthetic
cucauuauauuuacuaaag

SEQ ID NO: 4955 - RNA, 19 nt, Artificial Sequence
  Synthetic
ccucauuauauuuacuaaa

SEQ ID NO: 4956 - RNA, 19 nt, Artificial Sequence
  Synthetic
uaccuaaaggacgauuuac

SEQ ID NO: 4957 - RNA, 19 nt, Artificial Sequence
  Synthetic
uaauuauugcaagugaggu

SEQ ID NO: 4958 - RNA, 19 nt, Artificial Sequence
  Synthetic
cacaaacaauggaauggua

SEQ ID NO: 4959 - RNA, 19 nt, Artificial Sequence
  Synthetic
ccugcagcuacucuuugga

SEQ ID NO: 4960 - RNA, 19 nt, Artificial Sequence
  Synthetic
gcagcccaucaacuggaua

SEQ ID NO: 4961 - RNA, 19 nt, Artificial Sequence
  Synthetic
aucauuuguauucugcaug

SEQ ID NO: 4962 - RNA, 19 nt, Artificial Sequence
  Synthetic
cccugcagcuacucuuugg

SEQ ID NO: 4963 - RNA, 19 nt, Artificial Sequence
  Synthetic
agaggccagugggauggug

SEQ ID NO: 4964 - RNA, 19 nt, Artificial Sequence
  Synthetic
cauuuguauucugcauggu

SEQ ID NO: 4965 - RNA, 19 nt, Artificial Sequence
  Synthetic
gcaggcucagugaugucuu

SEQ ID NO: 4966 - RNA, 19 nt, Artificial Sequence
  Synthetic
caaaccaggccagcugauu

SEQ ID NO: 4967 - RNA, 19 nt, Artificial Sequence
  Synthetic
aauuauugcaagugagguu

SEQ ID NO: 4968 - RNA, 19 nt, Artificial Sequence
  Synthetic
ggcagcccauccaugaggu

SEQ ID NO: 4969 - RNA, 19 nt, Artificial Sequence
  Synthetic
gcacaaacaauggaauggu

SEQ ID NO: 4970 - RNA, 19 nt, Artificial Sequence
  Synthetic
ucauuuguauucugcaugg

SEQ ID NO: 4971 - RNA, 19 nt, Artificial Sequence
  Synthetic
ggcuggucagaugacgaag

SEQ ID NO: 4972 - RNA, 19 nt, Artificial Sequence
  Synthetic
guccugagcaaguucacag

SEQ ID NO: 4973 - RNA, 19 nt, Artificial Sequence
  Synthetic
ggcaggcucagugaugucu

SEQ ID NO: 4974 - RNA, 19 nt, Artificial Sequence
  Synthetic
cauuccaagccauuggcuc

SEQ ID NO: 4975 - RNA, 19 nt, Artificial Sequence
  Synthetic
cacagauggcaggcucagu

SEQ ID NO: 4976 - RNA, 19 nt, Artificial Sequence
  Synthetic
uggcucccucagcuucaau

SEQ ID NO: 4977 - RNA, 19 nt, Artificial Sequence
  Synthetic
aaagcugauggaccauaac

SEQ ID NO: 4978 - RNA, 19 nt, Artificial Sequence
  Synthetic
cugcacaggugaccacauu

SEQ ID NO: 4979 - RNA, 19 nt, Artificial Sequence
  Synthetic
guaucaaaccaggccagcu

SEQ ID NO: 4980 - RNA, 19 nt, Artificial Sequence
  Synthetic
aucugugaugguucagcca

SEQ ID NO: 4981 - RNA, 19 nt, Artificial Sequence
  Synthetic
gccagugggauggugggug

SEQ ID NO: 4982 - RNA, 19 nt, Artificial Sequence
  Synthetic
gucucauuccaagccauug

SEQ ID NO: 4983 - RNA, 19 nt, Artificial Sequence
  Synthetic
gcacucugcuuguggucca

SEQ ID NO: 4984 - RNA, 19 nt, Artificial Sequence
  Synthetic
ugcacaaacaauggaaugg

SEQ ID NO: 4985 - RNA, 19 nt, Artificial Sequence
  Synthetic
gcccauccaugagguccug

SEQ ID NO: 4986 - RNA, 19 nt, Artificial Sequence
  Synthetic
uuguccugagcaaguucac

SEQ ID NO: 4987 - RNA, 19 nt, Artificial Sequence
  Synthetic
cccauccaugagguccugg

SEQ ID NO: 4988 - RNA, 19 nt, Artificial Sequence
  Synthetic
caucugugaugguucagcc

SEQ ID NO: 4989 - RNA, 19 nt, Artificial Sequence
  Synthetic
caacuggauagucagcacc

SEQ ID NO: 4990 - RNA, 19 nt, Artificial Sequence
  Synthetic
cagucucauuccaagccau

SEQ ID NO: 4991 - RNA, 19 nt, Artificial Sequence
  Synthetic
ggcucagugaugucuuccc

SEQ ID NO: 4992 - RNA, 19 nt, Artificial Sequence
  Synthetic
gaugucuucccugucacca

SEQ ID NO: 4993 - RNA, 19 nt, Artificial Sequence
  Synthetic
gacauuagugggaugagca

SEQ ID NO: 4994 - RNA, 19 nt, Artificial Sequence
  Synthetic
cagcccaucaacuggauag

SEQ ID NO: 4995 - RNA, 19 nt, Artificial Sequence
  Synthetic
cagcccauccaugaggucc

SEQ ID NO: 4996 - RNA, 19 nt, Artificial Sequence
  Synthetic
uuuaucagaggccaguggg

SEQ ID NO: 4997 - RNA, 19 nt, Artificial Sequence
  Synthetic
uuguccucagacauucgga

SEQ ID NO: 4998 - RNA, 19 nt, Artificial Sequence
  Synthetic
gcagucucauuccaagcca

SEQ ID NO: 4999 - RNA, 19 nt, Artificial Sequence
  Synthetic
cacauuuauaucaucugaa

SEQ ID NO: 5000 - RNA, 19 nt, Artificial Sequence
  Synthetic
guuucuuguaaucuugugg

SEQ ID NO: 5001 - RNA, 19 nt, Artificial Sequence
  Synthetic
uauaauuauugcaagugag

SEQ ID NO: 5002 - RNA, 19 nt, Artificial Sequence
  Synthetic
cuuauaauuauugcaagug

SEQ ID NO: 5003 - RNA, 19 nt, Artificial Sequence
  Synthetic
uuuguauucugcaugguac

SEQ ID NO: 5004 - RNA, 19 nt, Artificial Sequence
  Synthetic
guucugaacaagacguuga

SEQ ID NO: 5005 - RNA, 19 nt, Artificial Sequence
  Synthetic
caaacuguguagaugggau

SEQ ID NO: 5006 - RNA, 19 nt, Artificial Sequence
  Synthetic
caucaaaucagcuugagua

SEQ ID NO: 5007 - RNA, 19 nt, Artificial Sequence
  Synthetic
uuauuaaccaccaccuggu

SEQ ID NO: 5008 - RNA, 19 nt, Artificial Sequence
  Synthetic
cuuccuguuuaguugcagc

SEQ ID NO: 5009 - RNA, 19 nt, Artificial Sequence
  Synthetic
aagauuucgaaucaaucca

SEQ ID NO: 5010 - RNA, 19 nt, Artificial Sequence
  Synthetic
accacauuuauaucaucug

SEQ ID NO: 5011 - RNA, 19 nt, Artificial Sequence
  Synthetic
guacaauagcagacaccau

SEQ ID NO: 5012 - RNA, 19 nt, Artificial Sequence
  Synthetic
cguuucuuguaaucuugug

SEQ ID NO: 5013 - RNA, 19 nt, Artificial Sequence
  Synthetic
gcuguuucuacaucauuug

SEQ ID NO: 5014 - RNA, 19 nt, Artificial Sequence
  Synthetic
uuucuuguaaucuuguggc

SEQ ID NO: 5015 - RNA, 19 nt, Artificial Sequence
  Synthetic
uguuucuacaucauuugua

SEQ ID NO: 5016 - RNA, 19 nt, Artificial Sequence
  Synthetic
acaaagggcaagauuucga

SEQ ID NO: 5017 - RNA, 19 nt, Artificial Sequence
  Synthetic
aucaucuugauaguuaauc

SEQ ID NO: 5018 - RNA, 19 nt, Artificial Sequence
  Synthetic
acaacacagaauccacugg

SEQ ID NO: 5019 - RNA, 19 nt, Artificial Sequence
  Synthetic
caauccaacaguagccuuu

SEQ ID NO: 5020 - RNA, 19 nt, Artificial Sequence
  Synthetic
aucaauaucagcuacuugu

SEQ ID NO: 5021 - RNA, 19 nt, Artificial Sequence
  Synthetic
acccaucucauguuccauc

SEQ ID NO: 5022 - RNA, 19 nt, Artificial Sequence
  Synthetic
aaguucugcaucaucuuga

SEQ ID NO: 5023 - RNA, 19 nt, Artificial Sequence
  Synthetic
acuccaucaaaucagcuug

SEQ ID NO: 5024 - RNA, 19 nt, Artificial Sequence
  Synthetic
aaagauuccugagagucca

SEQ ID NO: 5025 - RNA, 19 nt, Artificial Sequence
  Synthetic
aacaauggaaugguauuua

SEQ ID NO: 5026 - RNA, 19 nt, Artificial Sequence
  Synthetic
agcuccuucuugauguaau

SEQ ID NO: 5027 - RNA, 19 nt, Artificial Sequence
  Synthetic
gcaucugaaagauuccuga

SEQ ID NO: 5028 - RNA, 19 nt, Artificial Sequence
  Synthetic
ucaucuugauaguuaauca

SEQ ID NO: 5029 - RNA, 19 nt, Artificial Sequence
  Synthetic
uucauuccuagagugaagu

SEQ ID NO: 5030 - RNA, 19 nt, Artificial Sequence
  Synthetic
aaguuuacaacugcauguu

SEQ ID NO: 5031 - RNA, 19 nt, Artificial Sequence
  Synthetic
aacuccaucaaaucagcuu

SEQ ID NO: 5032 - RNA, 19 nt, Artificial Sequence
  Synthetic
uauaucaucugaacccaga

SEQ ID NO: 5033 - RNA, 19 nt, Artificial Sequence
  Synthetic
cauuccuagagugaaguaa

SEQ ID NO: 5034 - RNA, 19 nt, Artificial Sequence
  Synthetic
cagcaucugaaagauuccu

SEQ ID NO: 5035 - RNA, 19 nt, Artificial Sequence
  Synthetic
uacaacugcauguuucagc

SEQ ID NO: 5036 - RNA, 19 nt, Artificial Sequence
  Synthetic
augugcacgaacaagcaac

SEQ ID NO: 5037 - RNA, 19 nt, Artificial Sequence
  Synthetic
accuucaacuauuucuucc

SEQ ID NO: 5038 - RNA, 19 nt, Artificial Sequence
  Synthetic
uaaucuuguggcuuguccu

SEQ ID NO: 5039 - RNA, 19 nt, Artificial Sequence
  Synthetic
caucugaggagaacgcaug

SEQ ID NO: 5040 - RNA, 19 nt, Artificial Sequence
  Synthetic
aacgguagcugggaucauc

SEQ ID NO: 5041 - RNA, 19 nt, Artificial Sequence
  Synthetic
agagcacagauggcaggcu

SEQ ID NO: 5042 - RNA, 19 nt, Artificial Sequence
  Synthetic
aucauccuggcgauaucca

SEQ ID NO: 5043 - RNA, 19 nt, Artificial Sequence
  Synthetic
gcuggucagaugacgaaga

SEQ ID NO: 5044 - RNA, 19 nt, Artificial Sequence
  Synthetic
uguccugagcaaguucaca

SEQ ID NO: 5045 - RNA, 19 nt, Artificial Sequence
  Synthetic
agaauuccagcugcacagg

SEQ ID NO: 5046 - RNA, 19 nt, Artificial Sequence
  Synthetic
cuuguccugagcaaguuca

SEQ ID NO: 5047 - RNA, 19 nt, Artificial Sequence
  Synthetic
aucaacuggauagucagca

SEQ ID NO: 5048 - RNA, 19 nt, Artificial Sequence
  Synthetic
ugaccacauuuauaucauc

SEQ ID NO: 5049 - RNA, 19 nt, Artificial Sequence
  Synthetic
ucaacuggauagucagcac

SEQ ID NO: 5050 - RNA, 19 nt, Artificial Sequence
  Synthetic
cccaucaacuggauaguca

SEQ ID NO: 5051 - RNA, 19 nt, Artificial Sequence
  Synthetic
uccuuguccugagcaaguu

SEQ ID NO: 5052 - RNA, 19 nt, Artificial Sequence
  Synthetic
ccaucaacuggauagucag

SEQ ID NO: 5053 - RNA, 19 nt, Artificial Sequence
  Synthetic
ggacauuagugggaugagc

SEQ ID NO: 5054 - RNA, 19 nt, Artificial Sequence
  Synthetic
caucaacuggauagucagc

SEQ ID NO: 5055 - RNA, 19 nt, Artificial Sequence
  Synthetic
gugaccacauuuauaucau

SEQ ID NO: 5056 - RNA, 19 nt, Artificial Sequence
  Synthetic
uggacauuagugggaugag

SEQ ID NO: 5057 - RNA, 19 nt, Artificial Sequence
  Synthetic
uucaaugggagaauaaagc

SEQ ID NO: 5058 - RNA, 19 nt, Artificial Sequence
  Synthetic
acuggauagucagcaccag

SEQ ID NO: 5059 - RNA, 19 nt, Artificial Sequence
  Synthetic
ugagaguccaaagacaguu

SEQ ID NO: 5060 - RNA, 19 nt, Artificial Sequence
  Synthetic
gaugggaucugcaugcccu

SEQ ID NO: 5061 - RNA, 19 nt, Artificial Sequence
  Synthetic
aggugaccacauuuauauc

SEQ ID NO: 5062 - RNA, 19 nt, Artificial Sequence
  Synthetic
uuuaguugcagcaucugaa

SEQ ID NO: 5063 - RNA, 19 nt, Artificial Sequence
  Synthetic
caaccuucaacuauuucuu

SEQ ID NO: 5064 - RNA, 19 nt, Artificial Sequence
  Synthetic
auagcuaggaucauccugg

SEQ ID NO: 5065 - RNA, 19 nt, Artificial Sequence
  Synthetic
ccagacuuaaagauggcca

SEQ ID NO: 5066 - RNA, 19 nt, Artificial Sequence
  Synthetic
cuguccaucaauaucagcu

SEQ ID NO: 5067 - RNA, 19 nt, Artificial Sequence
  Synthetic
ucgguugugaacaucccga

SEQ ID NO: 5068 - RNA, 19 nt, Artificial Sequence
  Synthetic
cauuccaccagcuucuaca

SEQ ID NO: 5069 - RNA, 19 nt, Artificial Sequence
  Synthetic
uagguccucauuauauuua

SEQ ID NO: 5070 - RNA, 19 nt, Artificial Sequence
  Synthetic
cccucaucuaaugucucag

SEQ ID NO: 5071 - RNA, 19 nt, Artificial Sequence
  Synthetic
gguccucauuauauuuacu

SEQ ID NO: 5072 - RNA, 19 nt, Artificial Sequence
  Synthetic
aggacuugggagguaucca

SEQ ID NO: 5073 - RNA, 19 nt, Artificial Sequence
  Synthetic
uccauacccaaggcauccu

SEQ ID NO: 5074 - RNA, 19 nt, Artificial Sequence
  Synthetic
ucugcaugguacguacaau

SEQ ID NO: 5075 - RNA, 19 nt, Artificial Sequence
  Synthetic
agauuccugagaguccaaa

SEQ ID NO: 5076 - RNA, 19 nt, Artificial Sequence
  Synthetic
agauuucgaaucaauccaa

SEQ ID NO: 5077 - RNA, 19 nt, Artificial Sequence
  Synthetic
augguauuuaguccucuga

SEQ ID NO: 5078 - RNA, 19 nt, Artificial Sequence
  Synthetic
cauacccaaggcauccugg

SEQ ID NO: 5079 - RNA, 19 nt, Artificial Sequence
  Synthetic
cacccaucucauguuccau

SEQ ID NO: 5080 - RNA, 19 nt, Artificial Sequence
  Synthetic
aaucaauccaacaguagcc

SEQ ID NO: 5081 - RNA, 19 nt, Artificial Sequence
  Synthetic
agcccauccaugagguccu

SEQ ID NO: 5082 - RNA, 19 nt, Artificial Sequence
  Synthetic
agaugacgaagagcacaga

SEQ ID NO: 5083 - RNA, 19 nt, Artificial Sequence
  Synthetic
gccauguccaacuccauca

SEQ ID NO: 5084 - RNA, 19 nt, Artificial Sequence
  Synthetic
gggaucugcaugcccucau

SEQ ID NO: 5085 - RNA, 19 nt, Artificial Sequence
  Synthetic
agcccaucaacuggauagu

SEQ ID NO: 5086 - RNA, 19 nt, Artificial Sequence
  Synthetic
ugggaucugcaugcccuca

SEQ ID NO: 5087 - RNA, 19 nt, Artificial Sequence
  Synthetic
ucauccuggcgauauccaa

SEQ ID NO: 5088 - RNA, 19 nt, Artificial Sequence
  Synthetic
cauccaugagguccugggc

SEQ ID NO: 5089 - RNA, 19 nt, Artificial Sequence
  Synthetic
auugcacguguggcaaguu

SEQ ID NO: 5090 - RNA, 19 nt, Artificial Sequence
  Synthetic
cacucauacaggacuuggg

SEQ ID NO: 5091 - RNA, 19 nt, Artificial Sequence
  Synthetic
gcauguuucagcaucugug

SEQ ID NO: 5092 - RNA, 19 nt, Artificial Sequence
  Synthetic
agguuaugcaaggucccag

SEQ ID NO: 5093 - RNA, 19 nt, Artificial Sequence
  Synthetic
aaacaacacagaauccacu

SEQ ID NO: 5094 - RNA, 19 nt, Artificial Sequence
  Synthetic
aaguccuaaagcuugcauu

SEQ ID NO: 5095 - RNA, 19 nt, Artificial Sequence
  Synthetic
acaaccuucaacuauuucu

SEQ ID NO: 5096 - RNA, 19 nt, Artificial Sequence
  Synthetic
acuauuucuuccaugcgga

SEQ ID NO: 5097 - RNA, 19 nt, Artificial Sequence
  Synthetic
augucucagggaacauagc

SEQ ID NO: 5098 - RNA, 19 nt, Artificial Sequence
  Synthetic
auugccuuuaccacucaga

SEQ ID NO: 5099 - RNA, 19 nt, Artificial Sequence
  Synthetic
ugaaguccuaaagcuugca

SEQ ID NO: 5100 - RNA, 19 nt, Artificial Sequence
  Synthetic
agucauugcauacugucca

SEQ ID NO: 5101 - RNA, 19 nt, Artificial Sequence
  Synthetic
uccucauuauauuuacuaa

SEQ ID NO: 5102 - RNA, 19 nt, Artificial Sequence
  Synthetic
auagcagacaccaucugag

SEQ ID NO: 5103 - RNA, 19 nt, Artificial Sequence
  Synthetic
aauaucagcuacuuguucu

SEQ ID NO: 5104 - RNA, 19 nt, Artificial Sequence
  Synthetic
cauccuggcgauauccaag

SEQ ID NO: 5105 - RNA, 19 nt, Artificial Sequence
  Synthetic
augacgaagagcacagaug

SEQ ID NO: 5106 - RNA, 19 nt, Artificial Sequence
  Synthetic
uggauagucagcaccaggg

SEQ ID NO: 5107 - RNA, 19 nt, Artificial Sequence
  Synthetic
aagcaacugaacuagucgu

SEQ ID NO: 5108 - RNA, 19 nt, Artificial Sequence
  Synthetic
accaauaucaaguccaaga

SEQ ID NO: 5109 - RNA, 19 nt, Artificial Sequence
  Synthetic
acgauagcuaggaucaucc

SEQ ID NO: 5110 - RNA, 19 nt, Artificial Sequence
  Synthetic
uuucuacaucauuuguauu

SEQ ID NO: 5111 - RNA, 19 nt, Artificial Sequence
  Synthetic
ucagcaucugugaugguuc

SEQ ID NO: 5112 - RNA, 19 nt, Artificial Sequence
  Synthetic
ucccgagcuaggaugugaa

SEQ ID NO: 5113 - RNA, 19 nt, Artificial Sequence
  Synthetic
uguguagaugggaucugca

SEQ ID NO: 5114 - RNA, 19 nt, Artificial Sequence
  Synthetic
auggaaugguauuuagucc

SEQ ID NO: 5115 - RNA, 19 nt, Artificial Sequence
  Synthetic
augguacguacaauagcag

SEQ ID NO: 5116 - RNA, 19 nt, Artificial Sequence
  Synthetic
aaugguauuuaguccucug

SEQ ID NO: 5117 - RNA, 19 nt, Artificial Sequence
  Synthetic
uccaacaguagccuuuauc

SEQ ID NO: 5118 - RNA, 19 nt, Artificial Sequence
  Synthetic
gaccacauuuauaucaucu

SEQ ID NO: 5119 - RNA, 19 nt, Artificial Sequence
  Synthetic
acgcaaaggugcaugauuu

SEQ ID NO: 5120 - RNA, 19 nt, Artificial Sequence
  Synthetic
uuugaaggcagucugucgu

SEQ ID NO: 5121 - RNA, 19 nt, Artificial Sequence
  Synthetic
guccucauuauauuuacua

SEQ ID NO: 5122 - RNA, 19 nt, Artificial Sequence
  Synthetic
uaaguauagguccucauua

SEQ ID NO: 5123 - RNA, 19 nt, Artificial Sequence
  Synthetic
acaacugcauguuucagca

SEQ ID NO: 5124 - RNA, 19 nt, Artificial Sequence
  Synthetic
auguccaacuccaucaaau

SEQ ID NO: 5125 - RNA, 19 nt, Artificial Sequence
  Synthetic
uauaccacccacuuggcag

SEQ ID NO: 5126 - RNA, 19 nt, Artificial Sequence
  Synthetic
aaccacaacugguagucca

SEQ ID NO: 5127 - RNA, 19 nt, Artificial Sequence
  Synthetic
auaacugcagccuuauuaa

SEQ ID NO: 5128 - RNA, 19 nt, Artificial Sequence
  Synthetic
uuuagcuccuucuugaugu

SEQ ID NO: 5129 - RNA, 19 nt, Artificial Sequence
  Synthetic
gaucauccuggcgauaucc

SEQ ID NO: 5130 - RNA, 19 nt, Artificial Sequence
  Synthetic
agugaaguaacucugucag

SEQ ID NO: 5131 - RNA, 19 nt, Artificial Sequence
  Synthetic
gugaugucuucccugucac

SEQ ID NO: 5132 - RNA, 19 nt, Artificial Sequence
  Synthetic
cuggacauuagugggauga

SEQ ID NO: 5133 - RNA, 19 nt, Artificial Sequence
  Synthetic
cgaagagcacagauggcag

SEQ ID NO: 5134 - RNA, 19 nt, Artificial Sequence
  Synthetic
caggugaccacauuuauau

SEQ ID NO: 5135 - RNA, 19 nt, Artificial Sequence
  Synthetic
auagucagcaccagggugg

SEQ ID NO: 5136 - RNA, 19 nt, Artificial Sequence
  Synthetic
ggucagaugacgaagagca

SEQ ID NO: 5137 - RNA, 19 nt, Artificial Sequence
  Synthetic
ucagugaugucuucccugu

SEQ ID NO: 5138 - RNA, 19 nt, Artificial Sequence
  Synthetic
uccauggccauguccaacu

SEQ ID NO: 5139 - RNA, 19 nt, Artificial Sequence
  Synthetic
ucugugaugguucagccaa

SEQ ID NO: 5140 - RNA, 19 nt, Artificial Sequence
  Synthetic
aucugcaugcccucaucua

SEQ ID NO: 5141 - RNA, 19 nt, Artificial Sequence
  Synthetic
gaucugcaugcccucaucu

SEQ ID NO: 5142 - RNA, 19 nt, Artificial Sequence
  Synthetic
gaugacgaagagcacagau

SEQ ID NO: 5143 - RNA, 19 nt, Artificial Sequence
  Synthetic
uugcacguguggcaaguuc

SEQ ID NO: 5144 - RNA, 19 nt, Artificial Sequence
  Synthetic
ugacgaagagcacagaugg

SEQ ID NO: 5145 - RNA, 19 nt, Artificial Sequence
  Synthetic
uugcuuucuugguugccau

SEQ ID NO: 5146 - RNA, 19 nt, Artificial Sequence
  Synthetic
guuuacaacugcauguuuc

SEQ ID NO: 5147 - RNA, 19 nt, Artificial Sequence
  Synthetic
ggguguaagagcuuaacca

SEQ ID NO: 5148 - RNA, 19 nt, Artificial Sequence
  Synthetic
cauuauauuuacuaaagcu

SEQ ID NO: 5149 - RNA, 19 nt, Artificial Sequence
  Synthetic
uucugcaucaucuugauag

SEQ ID NO: 5150 - RNA, 19 nt, Artificial Sequence
  Synthetic
cugaacaagacguugacuu

SEQ ID NO: 5151 - RNA, 19 nt, Artificial Sequence
  Synthetic
caagacguugacuuggauc

SEQ ID NO: 5152 - RNA, 19 nt, Artificial Sequence
  Synthetic
ugaggagaacgcaugauag

SEQ ID NO: 5153 - RNA, 19 nt, Artificial Sequence
  Synthetic
uauagguccucauuauauu

SEQ ID NO: 5154 - RNA, 19 nt, Artificial Sequence
  Synthetic
uagagcagacagauagcac

SEQ ID NO: 5155 - RNA, 19 nt, Artificial Sequence
  Synthetic
uagcgugucuggaagcuuc

SEQ ID NO: 5156 - RNA, 19 nt, Artificial Sequence
  Synthetic
caucuuguucuuauaauua

SEQ ID NO: 5157 - RNA, 19 nt, Artificial Sequence
  Synthetic
guuucuacaucauuuguau

SEQ ID NO: 5158 - RNA, 19 nt, Artificial Sequence
  Synthetic
uuauuacuagagcagacag

SEQ ID NO: 5159 - RNA, 19 nt, Artificial Sequence
  Synthetic
caugguacguacaauagca

SEQ ID NO: 5160 - RNA, 19 nt, Artificial Sequence
  Synthetic
acagauagcaccuucagca

SEQ ID NO: 5161 - RNA, 19 nt, Artificial Sequence
  Synthetic
augccuccagacuuaaaga

SEQ ID NO: 5162 - RNA, 19 nt, Artificial Sequence
  Synthetic
acaaacaauggaaugguau

SEQ ID NO: 5163 - RNA, 19 nt, Artificial Sequence
  Synthetic
aucaauccaacaguagccu

SEQ ID NO: 5164 - RNA, 19 nt, Artificial Sequence
  Synthetic
agcugauggaccauaacug

SEQ ID NO: 5165 - RNA, 19 nt, Artificial Sequence
  Synthetic
uggcagaccaucaucuugu

SEQ ID NO: 5166 - RNA, 19 nt, Artificial Sequence
  Synthetic
aacagcagcugcauauguc

SEQ ID NO: 5167 - RNA, 19 nt, Artificial Sequence
  Synthetic
uaagcccucacgaugaugg

SEQ ID NO: 5168 - RNA, 19 nt, Artificial Sequence
  Synthetic
acguugacuuggaucuguc

SEQ ID NO: 5169 - RNA, 19 nt, Artificial Sequence
  Synthetic
ugcccucaucuaaugucuc

SEQ ID NO: 5170 - RNA, 19 nt, Artificial Sequence
  Synthetic
aguccauagugaaggcgaa

SEQ ID NO: 5171 - RNA, 19 nt, Artificial Sequence
  Synthetic
ugaacccagaagcugaaca

SEQ ID NO: 5172 - RNA, 19 nt, Artificial Sequence
  Synthetic
ccaauaucaaguccaagau

SEQ ID NO: 5173 - RNA, 19 nt, Artificial Sequence
  Synthetic
ucaguucagggauugcacg

SEQ ID NO: 5174 - RNA, 19 nt, Artificial Sequence
  Synthetic
gccuuauuaaccaccaccu

SEQ ID NO: 5175 - RNA, 19 nt, Artificial Sequence
  Synthetic
cagcaucaaacuguguaga

SEQ ID NO: 5176 - RNA, 19 nt, Artificial Sequence
  Synthetic
acugcauucugggccaucu

SEQ ID NO: 5177 - RNA, 19 nt, Artificial Sequence
  Synthetic
gccguuucuuguaaucuug

SEQ ID NO: 5178 - RNA, 19 nt, Artificial Sequence
  Synthetic
uuacaacugcauguuucag

SEQ ID NO: 5179 - RNA, 19 nt, Artificial Sequence
  Synthetic
uuaccacucagagaaggag

SEQ ID NO: 5180 - RNA, 19 nt, Artificial Sequence
  Synthetic
ccaguaugaugagcuugcu

SEQ ID NO: 5181 - RNA, 19 nt, Artificial Sequence
  Synthetic
aucaucuuguucuuauaau

SEQ ID NO: 5182 - RNA, 19 nt, Artificial Sequence
  Synthetic
uauuacuagagcagacaga

SEQ ID NO: 5183 - RNA, 19 nt, Artificial Sequence
  Synthetic
auuauauuuacuaaagcuu

SEQ ID NO: 5184 - RNA, 19 nt, Artificial Sequence
  Synthetic
agcuucuacaauagccggc

SEQ ID NO: 5185 - RNA, 19 nt, Artificial Sequence
  Synthetic
cuuauuacuagagcagaca

SEQ ID NO: 5186 - RNA, 19 nt, Artificial Sequence
  Synthetic
ucuuguucuuauaauuauu

SEQ ID NO: 5187 - RNA, 19 nt, Artificial Sequence
  Synthetic
ccaaggcauccuggccaua

SEQ ID NO: 5188 - RNA, 19 nt, Artificial Sequence
  Synthetic
gugcaugauuugcgggaca

SEQ ID NO: 5189 - RNA, 19 nt, Artificial Sequence
  Synthetic
aaagacaguucugaacaag

SEQ ID NO: 5190 - RNA, 19 nt, Artificial Sequence
  Synthetic
ugaagcaucguaucacagc

SEQ ID NO: 5191 - RNA, 19 nt, Artificial Sequence
  Synthetic
acccauggacguacggcgc

SEQ ID NO: 5192 - RNA, 19 nt, Artificial Sequence
  Synthetic
acaauagcagacaccaucu

SEQ ID NO: 5193 - RNA, 19 nt, Artificial Sequence
  Synthetic
agaguccaaagacaguucu

SEQ ID NO: 5194 - RNA, 19 nt, Artificial Sequence
  Synthetic
uguagaugggaucugcaug

SEQ ID NO: 5195 - RNA, 19 nt, Artificial Sequence
  Synthetic
gaacaagagucccaaggag

SEQ ID NO: 5196 - RNA, 19 nt, Artificial Sequence
  Synthetic
gagcugugguaguggcacc

SEQ ID NO: 5197 - RNA, 19 nt, Artificial Sequence
  Synthetic
agcuugcauuccaccagcu

SEQ ID NO: 5198 - RNA, 19 nt, Artificial Sequence
  Synthetic
ugaacuagucguggaaugg

SEQ ID NO: 5199 - RNA, 19 nt, Artificial Sequence
  Synthetic
augguucagccaaacgcug

SEQ ID NO: 5200 - RNA, 19 nt, Artificial Sequence
  Synthetic
ugccuccagacuuaaagau

SEQ ID NO: 5201 - RNA, 19 nt, Artificial Sequence
  Synthetic
acccaaggcauccuggcca

SEQ ID NO: 5202 - RNA, 19 nt, Artificial Sequence
  Synthetic
uucuacaucauuuguauuc

SEQ ID NO: 5203 - RNA, 19 nt, Artificial Sequence
  Synthetic
ccuggaggcagcccaucca

SEQ ID NO: 5204 - RNA, 19 nt, Artificial Sequence
  Synthetic
ucccacccauggacguacg

SEQ ID NO: 5205 - RNA, 19 nt, Artificial Sequence
  Synthetic
acguacaauagcagacacc

SEQ ID NO: 5206 - RNA, 19 nt, Artificial Sequence
  Synthetic
agagcagacagauagcacc

SEQ ID NO: 5207 - RNA, 19 nt, Artificial Sequence
  Synthetic
ugguaguccauagugaagg

SEQ ID NO: 5208 - RNA, 19 nt, Artificial Sequence
  Synthetic
cagaagcugaacaagaguc

SEQ ID NO: 5209 - RNA, 19 nt, Artificial Sequence
  Synthetic
agcaucaaacuguguagau

SEQ ID NO: 5210 - RNA, 19 nt, Artificial Sequence
  Synthetic
auaaagcagcugcacaaac

SEQ ID NO: 5211 - RNA, 19 nt, Artificial Sequence
  Synthetic
aacugaaagccguuucuug

SEQ ID NO: 5212 - RNA, 19 nt, Artificial Sequence
  Synthetic
cacgaacaagcaacugaac

SEQ ID NO: 5213 - RNA, 19 nt, Artificial Sequence
  Synthetic
ccacauuuauaucaucuga

SEQ ID NO: 5214 - RNA, 19 nt, Artificial Sequence
  Synthetic
uagccaagaauuuaacauu

SEQ ID NO: 5215 - RNA, 19 nt, Artificial Sequence
  Synthetic
uuuauaucaucugaaccca

SEQ ID NO: 5216 - RNA, 19 nt, Artificial Sequence
  Synthetic
gguacaaccuucaacuauu

SEQ ID NO: 5217 - RNA, 19 nt, Artificial Sequence
  Synthetic
ucaaguuuacaacugcaug

SEQ ID NO: 5218 - RNA, 19 nt, Artificial Sequence
  Synthetic
guuacacuuuauucagauu

SEQ ID NO: 5219 - RNA, 19 nt, Artificial Sequence
  Synthetic
agucagcaccaggguggug

SEQ ID NO: 5220 - RNA, 19 nt, Artificial Sequence
  Synthetic
ccauggccauguccaacuc

SEQ ID NO: 5221 - RNA, 19 nt, Artificial Sequence
  Synthetic
gacguacggcgcuggguau

SEQ ID NO: 5222 - RNA, 19 nt, Artificial Sequence
  Synthetic
agauggccaguaagcccuc

SEQ ID NO: 5223 - RNA, 19 nt, Artificial Sequence
  Synthetic
augggaucugcaugcccuc

SEQ ID NO: 5224 - RNA, 19 nt, Artificial Sequence
  Synthetic
ggagaccuuccaucccuuc

SEQ ID NO: 5225 - RNA, 19 nt, Artificial Sequence
  Synthetic
uuguggcuuguccucagac

SEQ ID NO: 5226 - RNA, 19 nt, Artificial Sequence
  Synthetic
cucacgcaaaggugcauga

SEQ ID NO: 5227 - RNA, 19 nt, Artificial Sequence
  Synthetic
gcagcaucugaaagauucc

SEQ ID NO: 5228 - RNA, 19 nt, Artificial Sequence
  Synthetic
acuuggaucugucagguga

SEQ ID NO: 5229 - RNA, 19 nt, Artificial Sequence
  Synthetic
agacagauagcaccuucag

SEQ ID NO: 5230 - RNA, 19 nt, Artificial Sequence
  Synthetic
ugucggcuggucagaugac

SEQ ID NO: 5231 - RNA, 19 nt, Artificial Sequence
  Synthetic
cugaacuagucguggaaug

SEQ ID NO: 5232 - RNA, 19 nt, Artificial Sequence
  Synthetic
agaacgauagcuaggauca

SEQ ID NO: 5233 - RNA, 19 nt, Artificial Sequence
  Synthetic
gcuaggaugugaagggcuc

SEQ ID NO: 5234 - RNA, 19 nt, Artificial Sequence
  Synthetic
ggaucugcaugcccucauc

SEQ ID NO: 5235 - RNA, 19 nt, Artificial Sequence
  Synthetic
acugauuuacccuacccau

SEQ ID NO: 5236 - RNA, 19 nt, Artificial Sequence
  Synthetic
gucaguucagggauugcac

SEQ ID NO: 5237 - RNA, 19 nt, Artificial Sequence
  Synthetic
gcugcacaaacaauggaau

SEQ ID NO: 5238 - RNA, 19 nt, Artificial Sequence
  Synthetic
ugguaguggcaccagaaug

SEQ ID NO: 5239 - RNA, 19 nt, Artificial Sequence
  Synthetic
auuuguauucugcauggua

SEQ ID NO: 5240 - RNA, 19 nt, Artificial Sequence
  Synthetic
uagugaaggcgaacugcau

SEQ ID NO: 5241 - RNA, 19 nt, Artificial Sequence
  Synthetic
acuuaaagauggccaguaa

SEQ ID NO: 5242 - RNA, 19 nt, Artificial Sequence
  Synthetic
aucaucugaacccagaagc

SEQ ID NO: 5243 - RNA, 19 nt, Artificial Sequence
  Synthetic
gaccuuccaucccuuccug

SEQ ID NO: 5244 - RNA, 19 nt, Artificial Sequence
  Synthetic
uuucuugguugccauaagc

SEQ ID NO: 5245 - RNA, 19 nt, Artificial Sequence
  Synthetic
agugaugucuucccuguca

SEQ ID NO: 5246 - RNA, 19 nt, Artificial Sequence
  Synthetic
cuaggaucauccuggcgau

SEQ ID NO: 5247 - RNA, 19 nt, Artificial Sequence
  Synthetic
caauagccggcuuauuacu

SEQ ID NO: 5248 - RNA, 19 nt, Artificial Sequence
  Synthetic
gagcuguuucuacaucauu

SEQ ID NO: 5249 - RNA, 19 nt, Artificial Sequence
  Synthetic
cuuguggcuuguccucaga

SEQ ID NO: 5250 - RNA, 19 nt, Artificial Sequence
  Synthetic
caagagucccaaggagacc

SEQ ID NO: 5251 - RNA, 19 nt, Artificial Sequence
  Synthetic
ccaaagacaguucugaaca

SEQ ID NO: 5252 - RNA, 19 nt, Artificial Sequence
  Synthetic
gcugugguaguggcaccag

SEQ ID NO: 5253 - RNA, 19 nt, Artificial Sequence
  Synthetic
cugugucccacccauggac

SEQ ID NO: 5254 - RNA, 19 nt, Artificial Sequence
  Synthetic
gcccaccagcuaaacgcac

SEQ ID NO: 5255 - RNA, 19 nt, Artificial Sequence
  Synthetic
uguauucugcaugguacgu

SEQ ID NO: 5256 - RNA, 19 nt, Artificial Sequence
  Synthetic
caauucgguugugaacauc

SEQ ID NO: 5257 - RNA, 19 nt, Artificial Sequence
  Synthetic
uaugaugagcuugcuuucu

SEQ ID NO: 5258 - RNA, 19 nt, Artificial Sequence
  Synthetic
cugaacccagaagcugaac

SEQ ID NO: 5259 - RNA, 19 nt, Artificial Sequence
  Synthetic
ucguggaauggcacccugc

SEQ ID NO: 5260 - RNA, 19 nt, Artificial Sequence
  Synthetic
ugcauuccaccagcuucua

SEQ ID NO: 5261 - RNA, 19 nt, Artificial Sequence
  Synthetic
uucaacuauuucuuccaug

SEQ ID NO: 5262 - RNA, 19 nt, Artificial Sequence
  Synthetic
ucccugggcaccaauauca

SEQ ID NO: 5263 - RNA, 19 nt, Artificial Sequence
  Synthetic
uagaugggaucugcaugcc

SEQ ID NO: 5264 - RNA, 19 nt, Artificial Sequence
  Synthetic
cagcccgaaggacaguacg

SEQ ID NO: 5265 - RNA, 19 nt, Artificial Sequence
  Synthetic
ugaaggcagucugucguaa

SEQ ID NO: 5266 - RNA, 19 nt, Artificial Sequence
  Synthetic
cuguugcugccagugacua

SEQ ID NO: 5267 - RNA, 19 nt, Artificial Sequence
  Synthetic
uguggagaguuguaauggc

SEQ ID NO: 5268 - RNA, 19 nt, Artificial Sequence
  Synthetic
gguaguccauagugaaggc

SEQ ID NO: 5269 - RNA, 19 nt, Artificial Sequence
  Synthetic
uaacaauucgguugugaac

SEQ ID NO: 5270 - RNA, 19 nt, Artificial Sequence
  Synthetic
aaagguuaugcaagguccc

SEQ ID NO: 5271 - RNA, 19 nt, Artificial Sequence
  Synthetic
ucuuguaaucuuguggcuu

SEQ ID NO: 5272 - RNA, 19 nt, Artificial Sequence
  Synthetic
cagguaagacuguugcugc

SEQ ID NO: 5273 - RNA, 19 nt, Artificial Sequence
  Synthetic
gcuccuucuugauguaaua

SEQ ID NO: 5274 - RNA, 19 nt, Artificial Sequence
  Synthetic
cauaacugcagccuuauua

SEQ ID NO: 5275 - RNA, 19 nt, Artificial Sequence
  Synthetic
agccuuauuaaccaccacc

SEQ ID NO: 5276 - RNA, 19 nt, Artificial Sequence
  Synthetic
agccaaacgcuggacauua

SEQ ID NO: 5277 - RNA, 19 nt, Artificial Sequence
  Synthetic
ccuuuaccacucagagaag

SEQ ID NO: 5278 - RNA, 19 nt, Artificial Sequence
  Synthetic
cuucuuggugucggcuggu

SEQ ID NO: 5279 - RNA, 19 nt, Artificial Sequence
  Synthetic
uacaggacuugggagguau

SEQ ID NO: 5280 - RNA, 19 nt, Artificial Sequence
  Synthetic
aacugguaguccauaguga

SEQ ID NO: 5281 - RNA, 19 nt, Artificial Sequence
  Synthetic
guacggcgcuggguauccu

SEQ ID NO: 5282 - RNA, 19 nt, Artificial Sequence
  Synthetic
gcucagugaugucuucccu

SEQ ID NO: 5283 - RNA, 19 nt, Artificial Sequence
  Synthetic
ggaucauccuggcgauauc

SEQ ID NO: 5284 - RNA, 19 nt, Artificial Sequence
  Synthetic
ccaucaauaucagcuacuu

SEQ ID NO: 5285 - RNA, 19 nt, Artificial Sequence
  Synthetic
ggugaaguccuaaagcuug

SEQ ID NO: 5286 - RNA, 19 nt, Artificial Sequence
  Synthetic
ugauuugcgggacaaaggg

SEQ ID NO: 5287 - RNA, 19 nt, Artificial Sequence
  Synthetic
ucugcaugcccucaucuaa

SEQ ID NO: 5288 - RNA, 19 nt, Artificial Sequence
  Synthetic
cucugagcucgagucauug

SEQ ID NO: 5289 - RNA, 19 nt, Artificial Sequence
  Synthetic
gcauccuggccauauccac

SEQ ID NO: 5290 - RNA, 19 nt, Artificial Sequence
  Synthetic
acauuuauaucaucugaac

SEQ ID NO: 5291 - RNA, 19 nt, Artificial Sequence
  Synthetic
ugcagcuuccuuguccuga

SEQ ID NO: 5292 - RNA, 19 nt, Artificial Sequence
  Synthetic
guggcucccucagcuucaa

SEQ ID NO: 5293 - RNA, 19 nt, Artificial Sequence
  Synthetic
auggccauguccaacucca

SEQ ID NO: 5294 - RNA, 19 nt, Artificial Sequence
  Synthetic
acugcauguuucagcaucu

SEQ ID NO: 5295 - RNA, 19 nt, Artificial Sequence
  Synthetic
cccacuuggcagaccauca

SEQ ID NO: 5296 - RNA, 19 nt, Artificial Sequence
  Synthetic
caaguuuacaacugcaugu

SEQ ID NO: 5297 - RNA, 19 nt, Artificial Sequence
  Synthetic
cuagagugaaguaacucug

SEQ ID NO: 5298 - RNA, 19 nt, Artificial Sequence
  Synthetic
uacccucugagcucgaguc

SEQ ID NO: 5299 - RNA, 19 nt, Artificial Sequence
  Synthetic
cagacuuaaagauggccag

SEQ ID NO: 5300 - RNA, 19 nt, Artificial Sequence
  Synthetic
uuucucuugaagcaucgua

SEQ ID NO: 5301 - RNA, 19 nt, Artificial Sequence
  Synthetic
cugaagagagagcugguca

SEQ ID NO: 5302 - RNA, 19 nt, Artificial Sequence
  Synthetic
ggcucuguucugaagagag

SEQ ID NO: 5303 - RNA, 19 nt, Artificial Sequence
  Synthetic
ggucagcucaacugaaagc

SEQ ID NO: 5304 - RNA, 19 nt, Artificial Sequence
  Synthetic
uugcugcugugucccaccc

SEQ ID NO: 5305 - RNA, 19 nt, Artificial Sequence
  Synthetic
agggauugcacguguggca

SEQ ID NO: 5306 - RNA, 19 nt, Artificial Sequence
  Synthetic
uccugagcaaguucacaga

SEQ ID NO: 5307 - RNA, 19 nt, Artificial Sequence
  Synthetic
uguucuacaccauuacuca

SEQ ID NO: 5308 - RNA, 19 nt, Artificial Sequence
  Synthetic
gauuucgaaucaauccaac

SEQ ID NO: 5309 - RNA, 19 nt, Artificial Sequence
  Synthetic
aagguuguggagaguugua

SEQ ID NO: 5310 - RNA, 19 nt, Artificial Sequence
  Synthetic
cccacucauacaggacuug

SEQ ID NO: 5311 - RNA, 19 nt, Artificial Sequence
  Synthetic
agaccuuccaucccuuccu

SEQ ID NO: 5312 - RNA, 19 nt, Artificial Sequence
  Synthetic
cuagccaguaugaugagcu

SEQ ID NO: 5313 - RNA, 19 nt, Artificial Sequence
  Synthetic
gugaaguccuaaagcuugc

SEQ ID NO: 5314 - RNA, 19 nt, Artificial Sequence
  Synthetic
gcugcacaggugaccacau

SEQ ID NO: 5315 - RNA, 19 nt, Artificial Sequence
  Synthetic
ccaucaaaucagcuugagu

SEQ ID NO: 5316 - RNA, 19 nt, Artificial Sequence
  Synthetic
cugguuccauggccauguc

SEQ ID NO: 5317 - RNA, 19 nt, Artificial Sequence
  Synthetic
agguccucauuauauuuac

SEQ ID NO: 5318 - RNA, 19 nt, Artificial Sequence
  Synthetic
caacuauuucuuccaugcg

SEQ ID NO: 5319 - RNA, 19 nt, Artificial Sequence
  Synthetic
ccuguuuaguugcagcauc

SEQ ID NO: 5320 - RNA, 19 nt, Artificial Sequence
  Synthetic
cccaucucauguuccauca

SEQ ID NO: 5321 - RNA, 19 nt, Artificial Sequence
  Synthetic
cuuauuaaccaccaccugg

SEQ ID NO: 5322 - RNA, 19 nt, Artificial Sequence
  Synthetic
aucuuguggcuuguccuca

SEQ ID NO: 5323 - RNA, 19 nt, Artificial Sequence
  Synthetic
agacuuaaagauggccagu

SEQ ID NO: 5324 - RNA, 19 nt, Artificial Sequence
  Synthetic
agcucaacugaaagccguu

SEQ ID NO: 5325 - RNA, 19 nt, Artificial Sequence
  Synthetic
cgaaucaauccaacaguag

SEQ ID NO: 5326 - RNA, 19 nt, Artificial Sequence
  Synthetic
guaagagcuuaaccacaac

SEQ ID NO: 5327 - RNA, 19 nt, Artificial Sequence
  Synthetic
guccaccacuagccaguau

SEQ ID NO: 5328 - RNA, 19 nt, Artificial Sequence
  Synthetic
gcagcccauccaugagguc

SEQ ID NO: 5329 - RNA, 19 nt, Artificial Sequence
  Synthetic
uugugaacaucccgagcua

SEQ ID NO: 5330 - RNA, 19 nt, Artificial Sequence
  Synthetic
ggccacccaucucauguuc

SEQ ID NO: 5331 - RNA, 19 nt, Artificial Sequence
  Synthetic
gaaggcgaacugcauucug

SEQ ID NO: 5332 - RNA, 19 nt, Artificial Sequence
  Synthetic
gugucccacccauggacgu

SEQ ID NO: 5333 - RNA, 19 nt, Artificial Sequence
  Synthetic
agaauccacuggugaacca

SEQ ID NO: 5334 - RNA, 19 nt, Artificial Sequence
  Synthetic
aggaucauccuggcgauau

SEQ ID NO: 5335 - RNA, 19 nt, Artificial Sequence
  Synthetic
ccuuccaucccuuccuguu

SEQ ID NO: 5336 - RNA, 19 nt, Artificial Sequence
  Synthetic
gagagcuggucagcucaac

SEQ ID NO: 5337 - RNA, 19 nt, Artificial Sequence
  Synthetic
agccaagaauuuaacauuu

SEQ ID NO: 5338 - RNA, 19 nt, Artificial Sequence
  Synthetic
accagcuucuacaauagcc

SEQ ID NO: 5339 - RNA, 19 nt, Artificial Sequence
  Synthetic
aagagcuuaaccacaacug

SEQ ID NO: 5340 - RNA, 19 nt, Artificial Sequence
  Synthetic
gcagcaucaaacuguguag

SEQ ID NO: 5341 - RNA, 19 nt, Artificial Sequence
  Synthetic
cagggcaggaaugccucca

SEQ ID NO: 5342 - RNA, 19 nt, Artificial Sequence
  Synthetic
ggcaacugguaaacugucc

SEQ ID NO: 5343 - RNA, 19 nt, Artificial Sequence
  Synthetic
guaguggcaccagaaugga

SEQ ID NO: 5344 - RNA, 19 nt, Artificial Sequence
  Synthetic
cagugggauggugggugua

SEQ ID NO: 5345 - RNA, 19 nt, Artificial Sequence
  Synthetic
gcacagauggcaggcucag

SEQ ID NO: 5346 - RNA, 19 nt, Artificial Sequence
  Synthetic
accagggcaggaaugccuc

SEQ ID NO: 5347 - RNA, 19 nt, Artificial Sequence
  Synthetic
gucugucguaauagccaag

SEQ ID NO: 5348 - RNA, 19 nt, Artificial Sequence
  Synthetic
cucaucuaaugucucaggg

SEQ ID NO: 5349 - RNA, 19 nt, Artificial Sequence
  Synthetic
ugagcucgagucauugcau

SEQ ID NO: 5350 - RNA, 19 nt, Artificial Sequence
  Synthetic
guacgcacaagagccucua

SEQ ID NO: 5351 - RNA, 19 nt, Artificial Sequence
  Synthetic
ccuucauuccuagagugaa

SEQ ID NO: 5352 - RNA, 19 nt, Artificial Sequence
  Synthetic
uguaaucuuguggcuuguc

SEQ ID NO: 5353 - RNA, 19 nt, Artificial Sequence
  Synthetic
gcacguguggcaaguucug

SEQ ID NO: 5354 - RNA, 19 nt, Artificial Sequence
  Synthetic
ggaaagguuaugcaagguc

SEQ ID NO: 5355 - RNA, 19 nt, Artificial Sequence
  Synthetic
agaaggagcugugguagug

SEQ ID NO: 5356 - RNA, 19 nt, Artificial Sequence
  Synthetic
ccauacauaucccaaauag

SEQ ID NO: 5357 - RNA, 19 nt, Artificial Sequence
  Synthetic
aagacaguucugaacaaga

SEQ ID NO: 5358 - RNA, 19 nt, Artificial Sequence
  Synthetic
gguccauacccaaggcauc

SEQ ID NO: 5359 - RNA, 19 nt, Artificial Sequence
  Synthetic
auuccaccagcuucuacaa

SEQ ID NO: 5360 - RNA, 19 nt, Artificial Sequence
  Synthetic
ugcauaugucgccacaccu

SEQ ID NO: 5361 - RNA, 19 nt, Artificial Sequence
  Synthetic
uugucaguucagggauugc

SEQ ID NO: 5362 - RNA, 19 nt, Artificial Sequence
  Synthetic
ccggcuuauuacuagagca

SEQ ID NO: 5363 - RNA, 19 nt, Artificial Sequence
  Synthetic
cucugcuucuuggugucgg

SEQ ID NO: 5364 - RNA, 19 nt, Artificial Sequence
  Synthetic
ggcaaguucugcaucaucu

SEQ ID NO: 5365 - RNA, 19 nt, Artificial Sequence
  Synthetic
agaucuggcagcccaucaa

SEQ ID NO: 5366 - RNA, 19 nt, Artificial Sequence
  Synthetic
cugcuucuuggugucggcu

SEQ ID NO: 5367 - RNA, 19 nt, Artificial Sequence
  Synthetic
cugauuuacccuacccaua

SEQ ID NO: 5368 - RNA, 19 nt, Artificial Sequence
  Synthetic
cacuagccaguaugaugag

SEQ ID NO: 5369 - RNA, 19 nt, Artificial Sequence
  Synthetic
aaggcagucugucguaaua

SEQ ID NO: 5370 - RNA, 19 nt, Artificial Sequence
  Synthetic
uuugucaguucagggauug

SEQ ID NO: 5371 - RNA, 19 nt, Artificial Sequence
  Synthetic
aacaagagucccaaggaga

SEQ ID NO: 5372 - RNA, 19 nt, Artificial Sequence
  Synthetic
ggugguggccacccaucuc

SEQ ID NO: 5373 - RNA, 19 nt, Artificial Sequence
  Synthetic
gucguggaauggcacccug

SEQ ID NO: 5374 - RNA, 19 nt, Artificial Sequence
  Synthetic
uuccuagagugaaguaacu

SEQ ID NO: 5375 - RNA, 19 nt, Artificial Sequence
  Synthetic
gcaccaauaucaaguccaa

SEQ ID NO: 5376 - RNA, 19 nt, Artificial Sequence
  Synthetic
cgagcuaggaugugaaggg

SEQ ID NO: 5377 - RNA, 19 nt, Artificial Sequence
  Synthetic
aacgcaugauagcgugucu

SEQ ID NO: 5378 - RNA, 19 nt, Artificial Sequence
  Synthetic
agugaaggcgaacugcauu

SEQ ID NO: 5379 - RNA, 19 nt, Artificial Sequence
  Synthetic
cuuucuugguugccauaag

SEQ ID NO: 5380 - RNA, 19 nt, Artificial Sequence
  Synthetic
cucauacaggacuugggag

SEQ ID NO: 5381 - RNA, 19 nt, Artificial Sequence
  Synthetic
gugggaugguggguguaag

SEQ ID NO: 5382 - RNA, 19 nt, Artificial Sequence
  Synthetic
gucccaaggagaccuucca

SEQ ID NO: 5383 - RNA, 19 nt, Artificial Sequence
  Synthetic
agcuaggaugugaagggcu

SEQ ID NO: 5384 - RNA, 19 nt, Artificial Sequence
  Synthetic
caccuggaggcagcccauc

SEQ ID NO: 5385 - RNA, 19 nt, Artificial Sequence
  Synthetic
ucaucugaacccagaagcu

SEQ ID NO: 5386 - RNA, 19 nt, Artificial Sequence
  Synthetic
gagcacagauggcaggcuc

SEQ ID NO: 5387 - RNA, 19 nt, Artificial Sequence
  Synthetic
ggaaugccuccagacuuaa

SEQ ID NO: 5388 - RNA, 19 nt, Artificial Sequence
  Synthetic
gaauuccagcugcacaggu

SEQ ID NO: 5389 - RNA, 19 nt, Artificial Sequence
  Synthetic
aggugcaugauuugcggga

SEQ ID NO: 5390 - RNA, 19 nt, Artificial Sequence
  Synthetic
gcauaugucgccacaccuu

SEQ ID NO: 5391 - RNA, 19 nt, Artificial Sequence
  Synthetic
ucccucagcuucaauagcu

SEQ ID NO: 5392 - RNA, 19 nt, Artificial Sequence
  Synthetic
guugcugccagugacuaac

SEQ ID NO: 5393 - RNA, 19 nt, Artificial Sequence
  Synthetic
gcacgaacaagcaacugaa

SEQ ID NO: 5394 - RNA, 19 nt, Artificial Sequence
  Synthetic
cacuuggcagaccaucauc

SEQ ID NO: 5395 - RNA, 19 nt, Artificial Sequence
  Synthetic
uccaucccuuccuguuuag

SEQ ID NO: 5396 - RNA, 19 nt, Artificial Sequence
  Synthetic
gcaacugaacuagucgugg

SEQ ID NO: 5397 - RNA, 19 nt, Artificial Sequence
  Synthetic
aacaagcaacugaacuagu

SEQ ID NO: 5398 - RNA, 19 nt, Artificial Sequence
  Synthetic
acagaauccacuggugaac

SEQ ID NO: 5399 - RNA, 19 nt, Artificial Sequence
  Synthetic
ucaggauugccuuuaccac

SEQ ID NO: 5400 - RNA, 19 nt, Artificial Sequence
  Synthetic
ccauguccaacuccaucaa

SEQ ID NO: 5401 - RNA, 19 nt, Artificial Sequence
  Synthetic
uuccuuguccugagcaagu

SEQ ID NO: 5402 - RNA, 19 nt, Artificial Sequence
  Synthetic
cuggcagcccaucaacugg

SEQ ID NO: 5403 - RNA, 19 nt, Artificial Sequence
  Synthetic
guaugaugagcuugcuuuc

SEQ ID NO: 5404 - RNA, 19 nt, Artificial Sequence
  Synthetic
gcaugcccucaucuaaugu

SEQ ID NO: 5405 - RNA, 19 nt, Artificial Sequence
  Synthetic
acgcuggacauuaguggga

SEQ ID NO: 5406 - RNA, 19 nt, Artificial Sequence
  Synthetic
gcuugcuuucuugguugcc

SEQ ID NO: 5407 - RNA, 19 nt, Artificial Sequence
  Synthetic
guacaaccuucaacuauuu

SEQ ID NO: 5408 - RNA, 19 nt, Artificial Sequence
  Synthetic
acccuacccauacauaucc

SEQ ID NO: 5409 - RNA, 19 nt, Artificial Sequence
  Synthetic
uuacacuuuauucagauua

SEQ ID NO: 5410 - RNA, 19 nt, Artificial Sequence
  Synthetic
cuggguauccugaugugca

SEQ ID NO: 5411 - RNA, 19 nt, Artificial Sequence
  Synthetic
acaauagccggcuuauuac

SEQ ID NO: 5412 - RNA, 19 nt, Artificial Sequence
  Synthetic
uagccaguaugaugagcuu

SEQ ID NO: 5413 - RNA, 19 nt, Artificial Sequence
  Synthetic
caguucagggauugcacgu

SEQ ID NO: 5414 - RNA, 19 nt, Artificial Sequence
  Synthetic
uaagagcuuaaccacaacu

SEQ ID NO: 5415 - RNA, 19 nt, Artificial Sequence
  Synthetic
uuaaccaccaccugguccu

SEQ ID NO: 5416 - RNA, 19 nt, Artificial Sequence
  Synthetic
gccggcuuauuacuagagc

SEQ ID NO: 5417 - RNA, 19 nt, Artificial Sequence
  Synthetic
uguccaacuccaucaaauc

SEQ ID NO: 5418 - RNA, 19 nt, Artificial Sequence
  Synthetic
acgagcuguuucuacauca

SEQ ID NO: 5419 - RNA, 19 nt, Artificial Sequence
  Synthetic
uccuggccauauccaccag

SEQ ID NO: 5420 - RNA, 19 nt, Artificial Sequence
  Synthetic
accacuagccaguaugaug

SEQ ID NO: 5421 - RNA, 19 nt, Artificial Sequence
  Synthetic
aaacuguguagaugggauc

SEQ ID NO: 5422 - RNA, 19 nt, Artificial Sequence
  Synthetic
gagaacgcaugauagcgug

SEQ ID NO: 5423 - RNA, 19 nt, Artificial Sequence
  Synthetic
cgagucauugcauacuguc

SEQ ID NO: 5424 - RNA, 19 nt, Artificial Sequence
  Synthetic
cagcagguuacaacaacuu

SEQ ID NO: 5425 - RNA, 19 nt, Artificial Sequence
  Synthetic
ggcagucugucguaauagc

SEQ ID NO: 5426 - RNA, 19 nt, Artificial Sequence
  Synthetic
auugcugucaccuggaggc

SEQ ID NO: 5427 - RNA, 19 nt, Artificial Sequence
  Synthetic
uguucccacucauacagga

SEQ ID NO: 5428 - RNA, 19 nt, Artificial Sequence
  Synthetic
guguagaugggaucugcau

SEQ ID NO: 5429 - RNA, 19 nt, Artificial Sequence
  Synthetic
cccucacgaugaugggaaa

SEQ ID NO: 5430 - RNA, 19 nt, Artificial Sequence
  Synthetic
cucuauaccacccacuugg

SEQ ID NO: 5431 - RNA, 19 nt, Artificial Sequence
  Synthetic
gaaagguuaugcaaggucc

SEQ ID NO: 5432 - RNA, 19 nt, Artificial Sequence
  Synthetic
acucauacaggacuuggga

SEQ ID NO: 5433 - RNA, 19 nt, Artificial Sequence
  Synthetic
agcaacugaacuagucgug

SEQ ID NO: 5434 - RNA, 19 nt, Artificial Sequence
  Synthetic
aacuauuucuuccaugcgg

SEQ ID NO: 5435 - RNA, 19 nt, Artificial Sequence
  Synthetic
gcgaacugcauucugggcc

SEQ ID NO: 5436 - RNA, 19 nt, Artificial Sequence
  Synthetic
uuucugucugguuccaugg

SEQ ID NO: 5437 - RNA, 19 nt, Artificial Sequence
  Synthetic
cucaacugaaagccguuuc

SEQ ID NO: 5438 - RNA, 19 nt, Artificial Sequence
  Synthetic
cccuacccauacauauccc

SEQ ID NO: 5439 - RNA, 19 nt, Artificial Sequence
  Synthetic
agcugaacaagagucccaa

SEQ ID NO: 5440 - RNA, 19 nt, Artificial Sequence
  Synthetic
uaaugucucagggaacaua

SEQ ID NO: 5441 - RNA, 19 nt, Artificial Sequence
  Synthetic
gaaagauuccugagagucc

SEQ ID NO: 5442 - RNA, 19 nt, Artificial Sequence
  Synthetic
ucaauagcuucugcagcuu

SEQ ID NO: 5443 - RNA, 19 nt, Artificial Sequence
  Synthetic
gagcuaggaugugaagggc

SEQ ID NO: 5444 - RNA, 19 nt, Artificial Sequence
  Synthetic
ugcauucugggccaucucu

SEQ ID NO: 5445 - RNA, 19 nt, Artificial Sequence
  Synthetic
uccucuuccucaggauugc

SEQ ID NO: 5446 - RNA, 19 nt, Artificial Sequence
  Synthetic
ccauacccaaggcauccug

SEQ ID NO: 5447 - RNA, 19 nt, Artificial Sequence
  Synthetic
gucucagggaacauagcag

SEQ ID NO: 5448 - RNA, 19 nt, Artificial Sequence
  Synthetic
auaacaauucgguugugaa

SEQ ID NO: 5449 - RNA, 19 nt, Artificial Sequence
  Synthetic
aguaugaugagcuugcuuu

SEQ ID NO: 5450 - RNA, 19 nt, Artificial Sequence
  Synthetic
cucuuccucaggauugccu

SEQ ID NO: 5451 - RNA, 19 nt, Artificial Sequence
  Synthetic
uaaagcagcugcacaaaca

SEQ ID NO: 5452 - RNA, 19 nt, Artificial Sequence
  Synthetic
guccuaaagcuugcauucc

SEQ ID NO: 5453 - RNA, 19 nt, Artificial Sequence
  Synthetic
cagcuucuacaauagccgg

SEQ ID NO: 5454 - RNA, 19 nt, Artificial Sequence
  Synthetic
cuacaauagccggcuuauu

SEQ ID NO: 5455 - RNA, 19 nt, Artificial Sequence
  Synthetic
aucugaacccagaagcuga

SEQ ID NO: 5456 - RNA, 19 nt, Artificial Sequence
  Synthetic
cuguucccacucauacagg

SEQ ID NO: 5457 - RNA, 19 nt, Artificial Sequence
  Synthetic
agcuacuuguucuugagug

SEQ ID NO: 5458 - RNA, 19 nt, Artificial Sequence
  Synthetic
ccgagcuaggaugugaagg

SEQ ID NO: 5459 - RNA, 19 nt, Artificial Sequence
  Synthetic
ugcucacgcaaaggugcau

SEQ ID NO: 5460 - RNA, 19 nt, Artificial Sequence
  Synthetic
auccugaugugcacgaaca

SEQ ID NO: 5461 - RNA, 19 nt, Artificial Sequence
  Synthetic
ugcacgaacaagcaacuga

SEQ ID NO: 5462 - RNA, 19 nt, Artificial Sequence
  Synthetic
aaggugcaugauuugcggg

SEQ ID NO: 5463 - RNA, 19 nt, Artificial Sequence
  Synthetic
ccaacuccaucaaaucagc

SEQ ID NO: 5464 - RNA, 19 nt, Artificial Sequence
  Synthetic
uacgcacaagagccucuau

SEQ ID NO: 5465 - RNA, 19 nt, Artificial Sequence
  Synthetic
cugcagcuuccuuguccug

SEQ ID NO: 5466 - RNA, 19 nt, Artificial Sequence
  Synthetic
gaugguggguguaagagcu

SEQ ID NO: 5467 - RNA, 19 nt, Artificial Sequence
  Synthetic
uguuucagcaucugugaug

SEQ ID NO: 5468 - RNA, 19 nt, Artificial Sequence
  Synthetic
ccaccagcuucuacaauag

SEQ ID NO: 5469 - RNA, 19 nt, Artificial Sequence
  Synthetic
uccaugagguccugggcau

SEQ ID NO: 5470 - RNA, 19 nt, Artificial Sequence
  Synthetic
acccucugagcucgaguca

SEQ ID NO: 5471 - RNA, 19 nt, Artificial Sequence
  Synthetic
ggaugagcagcaucaaacu

SEQ ID NO: 5472 - RNA, 19 nt, Artificial Sequence
  Synthetic
cugucaccagcccgaagga

SEQ ID NO: 5473 - RNA, 19 nt, Artificial Sequence
  Synthetic
uaugucgccacaccuucau

SEQ ID NO: 5474 - RNA, 19 nt, Artificial Sequence
  Synthetic
agagcuggucagcucaacu

SEQ ID NO: 5475 - RNA, 19 nt, Artificial Sequence
  Synthetic
ccuguucccacucauacag

SEQ ID NO: 5476 - RNA, 19 nt, Artificial Sequence
  Synthetic
gcagcucguacccucugag

SEQ ID NO: 5477 - RNA, 19 nt, Artificial Sequence
  Synthetic
ccucuuccucaggauugcc

SEQ ID NO: 5478 - RNA, 19 nt, Artificial Sequence
  Synthetic
uccaccacuagccaguaug

SEQ ID NO: 5479 - RNA, 19 nt, Artificial Sequence
  Synthetic
uuguaaucuuguggcuugu

SEQ ID NO: 5480 - RNA, 19 nt, Artificial Sequence
  Synthetic
ggacaguacgcacaagagc

SEQ ID NO: 5481 - RNA, 19 nt, Artificial Sequence
  Synthetic
acuugggagguauccacau

SEQ ID NO: 5482 - RNA, 19 nt, Artificial Sequence
  Synthetic
aaagcagcugcacaaacaa

SEQ ID NO: 5483 - RNA, 19 nt, Artificial Sequence
  Synthetic
aaacagcagcugcauaugu

SEQ ID NO: 5484 - RNA, 19 nt, Artificial Sequence
  Synthetic
uucuugagugaaggacuga

SEQ ID NO: 5485 - RNA, 19 nt, Artificial Sequence
  Synthetic
gggaaagguuaugcaaggu

SEQ ID NO: 5486 - RNA, 19 nt, Artificial Sequence
  Synthetic
agcagcugcauaugucgcc

SEQ ID NO: 5487 - RNA, 19 nt, Artificial Sequence
  Synthetic
cguacaauagcagacacca

SEQ ID NO: 5488 - RNA, 19 nt, Artificial Sequence
  Synthetic
aucuaaugucucagggaac

SEQ ID NO: 5489 - RNA, 19 nt, Artificial Sequence
  Synthetic
auccaacaguagccuuuau

SEQ ID NO: 5490 - RNA, 19 nt, Artificial Sequence
  Synthetic
acuagucguggaauggcac

SEQ ID NO: 5491 - RNA, 19 nt, Artificial Sequence
  Synthetic
agagccucuauaccaccca

SEQ ID NO: 5492 - RNA, 19 nt, Artificial Sequence
  Synthetic
uccagacuuaaagauggcc

SEQ ID NO: 5493 - RNA, 19 nt, Artificial Sequence
  Synthetic
uucucccugggcaccaaua

SEQ ID NO: 5494 - RNA, 19 nt, Artificial Sequence
  Synthetic
cguacccucugagcucgag

SEQ ID NO: 5495 - RNA, 19 nt, Artificial Sequence
  Synthetic
ugcacguguggcaaguucu

SEQ ID NO: 5496 - RNA, 19 nt, Artificial Sequence
  Synthetic
agcuuaaccacaacuggua

SEQ ID NO: 5497 - RNA, 19 nt, Artificial Sequence
  Synthetic
gugaugguucagccaaacg

SEQ ID NO: 5498 - RNA, 19 nt, Artificial Sequence
  Synthetic
caccagcuucuacaauagc

SEQ ID NO: 5499 - RNA, 19 nt, Artificial Sequence
  Synthetic
ccagggcaggaaugccucc

SEQ ID NO: 5500 - RNA, 19 nt, Artificial Sequence
  Synthetic
uagucagcaccaggguggu

SEQ ID NO: 5501 - RNA, 19 nt, Artificial Sequence
  Synthetic
cgggacaaagggcaagauu

SEQ ID NO: 5502 - RNA, 19 nt, Artificial Sequence
  Synthetic
gcagcccaccagcuaaacg

SEQ ID NO: 5503 - RNA, 19 nt, Artificial Sequence
  Synthetic
gagcuggucagcucaacug

SEQ ID NO: 5504 - RNA, 19 nt, Artificial Sequence
  Synthetic
ggugaccacauuuauauca

SEQ ID NO: 5505 - RNA, 19 nt, Artificial Sequence
  Synthetic
gauugccuuuaccacucag

SEQ ID NO: 5506 - RNA, 19 nt, Artificial Sequence
  Synthetic
agcagacagauagcaccuu

SEQ ID NO: 5507 - RNA, 19 nt, Artificial Sequence
  Synthetic
ugaacaucccgagcuagga

SEQ ID NO: 5508 - RNA, 19 nt, Artificial Sequence
  Synthetic
cuccaucaaaucagcuuga

SEQ ID NO: 5509 - RNA, 19 nt, Artificial Sequence
  Synthetic
guucugaagagagagcugg

SEQ ID NO: 5510 - RNA, 19 nt, Artificial Sequence
  Synthetic
ucugguuccauggccaugu

SEQ ID NO: 5511 - RNA, 19 nt, Artificial Sequence
  Synthetic
ggacguacggcgcugggua

SEQ ID NO: 5512 - RNA, 19 nt, Artificial Sequence
  Synthetic
cgguacaaccuucaacuau

SEQ ID NO: 5513 - RNA, 19 nt, Artificial Sequence
  Synthetic
caggugaaguccuaaagcu

SEQ ID NO: 5514 - RNA, 19 nt, Artificial Sequence
  Synthetic
gcagcuacucuuuggaugu

SEQ ID NO: 5515 - RNA, 19 nt, Artificial Sequence
  Synthetic
gaugggaaagguuaugcaa

SEQ ID NO: 5516 - RNA, 19 nt, Artificial Sequence
  Synthetic
cgaacugcauucugggcca

SEQ ID NO: 5517 - RNA, 19 nt, Artificial Sequence
  Synthetic
aaagggcaagauuucgaau

SEQ ID NO: 5518 - RNA, 19 nt, Artificial Sequence
  Synthetic
ucuacaauagccggcuuau

SEQ ID NO: 5519 - RNA, 19 nt, Artificial Sequence
  Synthetic
auuugaaggcagucugucg

SEQ ID NO: 5520 - RNA, 19 nt, Artificial Sequence
  Synthetic
cugauggaccauaacugca

SEQ ID NO: 5521 - RNA, 19 nt, Artificial Sequence
  Synthetic
gggaugagcagcaucaaac

SEQ ID NO: 5522 - RNA, 19 nt, Artificial Sequence
  Synthetic
gccaaacgcuggacauuag

SEQ ID NO: 5523 - RNA, 19 nt, Artificial Sequence
  Synthetic
caucaauaucagcuacuug

SEQ ID NO: 5524 - RNA, 19 nt, Artificial Sequence
  Synthetic
gugaaguaacucugucaga

SEQ ID NO: 5525 - RNA, 19 nt, Artificial Sequence
  Synthetic
caagagccucuauaccacc

SEQ ID NO: 5526 - RNA, 19 nt, Artificial Sequence
  Synthetic
uauuaaccaccaccugguc

SEQ ID NO: 5527 - RNA, 19 nt, Artificial Sequence
  Synthetic
aggcagcccauccaugagg

SEQ ID NO: 5528 - RNA, 19 nt, Artificial Sequence
  Synthetic
uccugagaguccaaagaca

SEQ ID NO: 5529 - RNA, 19 nt, Artificial Sequence
  Synthetic
caauaucagcuacuuguuc

SEQ ID NO: 5530 - RNA, 19 nt, Artificial Sequence
  Synthetic
ggagcugugguaguggcac

SEQ ID NO: 5531 - RNA, 19 nt, Artificial Sequence
  Synthetic
ccugcucacgcaaaggugc

SEQ ID NO: 5532 - RNA, 19 nt, Artificial Sequence
  Synthetic
ggaucugucaggugaaguc

SEQ ID NO: 5533 - RNA, 19 nt, Artificial Sequence
  Synthetic
aaacaauggaaugguauuu

SEQ ID NO: 5534 - RNA, 19 nt, Artificial Sequence
  Synthetic
ucagcuacuuguucuugag

SEQ ID NO: 5535 - RNA, 19 nt, Artificial Sequence
  Synthetic
ugagcaaguucacagagga

SEQ ID NO: 5536 - RNA, 19 nt, Artificial Sequence
  Synthetic
gggcaggaaugccuccaga

SEQ ID NO: 5537 - RNA, 19 nt, Artificial Sequence
  Synthetic
caggaaugccuccagacuu

SEQ ID NO: 5538 - RNA, 19 nt, Artificial Sequence
  Synthetic
gcuccgguacaaccuucaa

SEQ ID NO: 5539 - RNA, 19 nt, Artificial Sequence
  Synthetic
acaucccgagcuaggaugu

SEQ ID NO: 5540 - RNA, 19 nt, Artificial Sequence
  Synthetic
augagcuugcuuucuuggu

SEQ ID NO: 5541 - RNA, 19 nt, Artificial Sequence
  Synthetic
cugugaugguucagccaaa

SEQ ID NO: 5542 - RNA, 19 nt, Artificial Sequence
  Synthetic
uucagggauugcacgugug

SEQ ID NO: 5543 - RNA, 19 nt, Artificial Sequence
  Synthetic
acuagccaguaugaugagc

SEQ ID NO: 5544 - RNA, 19 nt, Artificial Sequence
  Synthetic
uuacugauuuacccuaccc

SEQ ID NO: 5545 - RNA, 19 nt, Artificial Sequence
  Synthetic
cuuggaucugucaggugaa

SEQ ID NO: 5546 - RNA, 19 nt, Artificial Sequence
  Synthetic
cucaggauugccuuuacca

SEQ ID NO: 5547 - RNA, 19 nt, Artificial Sequence
  Synthetic
aagaacgauagcuaggauc

SEQ ID NO: 5548 - RNA, 19 nt, Artificial Sequence
  Synthetic
cggcuggucagaugacgaa

SEQ ID NO: 5549 - RNA, 19 nt, Artificial Sequence
  Synthetic
uugcagcaucugaaagauu

SEQ ID NO: 5550 - RNA, 19 nt, Artificial Sequence
  Synthetic
auagugaaggcgaacugca

SEQ ID NO: 5551 - RNA, 19 nt, Artificial Sequence
  Synthetic
cgauagcuaggaucauccu

SEQ ID NO: 5552 - RNA, 19 nt, Artificial Sequence
  Synthetic
uguucugaagagagagcug

SEQ ID NO: 5553 - RNA, 19 nt, Artificial Sequence
  Synthetic
auugcugcugugucccacc

SEQ ID NO: 5554 - RNA, 19 nt, Artificial Sequence
  Synthetic
gauagcuaggaucauccug

SEQ ID NO: 5555 - RNA, 19 nt, Artificial Sequence
  Synthetic
guauccacauccucuuccu

SEQ ID NO: 5556 - RNA, 19 nt, Artificial Sequence
  Synthetic
auuacuagagcagacagau

SEQ ID NO: 5557 - RNA, 19 nt, Artificial Sequence
  Synthetic
acgaugaugggaaagguua

SEQ ID NO: 5558 - RNA, 19 nt, Artificial Sequence
  Synthetic
caaugggagaauaaagcag

SEQ ID NO: 5559 - RNA, 19 nt, Artificial Sequence
  Synthetic
cuuuauucagauuacaauu

SEQ ID NO: 5560 - RNA, 19 nt, Artificial Sequence
  Synthetic
acccagaagcugaacaaga

SEQ ID NO: 5561 - RNA, 19 nt, Artificial Sequence
  Synthetic
uauccugaugugcacgaac

SEQ ID NO: 5562 - RNA, 19 nt, Artificial Sequence
  Synthetic
guggcaaguucugcaucau

SEQ ID NO: 5563 - RNA, 19 nt, Artificial Sequence
  Synthetic
acuguccaucaauaucagc

SEQ ID NO: 5564 - RNA, 19 nt, Artificial Sequence
  Synthetic
uggguguaagagcuuaacc

SEQ ID NO: 5565 - RNA, 19 nt, Artificial Sequence
  Synthetic
gauuugcgggacaaagggc

SEQ ID NO: 5566 - RNA, 19 nt, Artificial Sequence
  Synthetic
agcagcucguacccucuga

SEQ ID NO: 5567 - RNA, 19 nt, Artificial Sequence
  Synthetic
aguuuacaacugcauguuu

SEQ ID NO: 5568 - RNA, 19 nt, Artificial Sequence
  Synthetic
uugcgggacaaagggcaag

SEQ ID NO: 5569 - RNA, 19 nt, Artificial Sequence
  Synthetic
ugaaagccguuucuuguaa

SEQ ID NO: 5570 - RNA, 19 nt, Artificial Sequence
  Synthetic
ggccauauccaccagagug

SEQ ID NO: 5571 - RNA, 19 nt, Artificial Sequence
  Synthetic
gccuccagacuuaaagaug

SEQ ID NO: 5572 - RNA, 19 nt, Artificial Sequence
  Synthetic
acgaagagcacagauggca

SEQ ID NO: 5573 - RNA, 19 nt, Artificial Sequence
  Synthetic
ucugucguaauagccaaga

SEQ ID NO: 5574 - RNA, 19 nt, Artificial Sequence
  Synthetic
acccauacauaucccaaau

SEQ ID NO: 5575 - RNA, 19 nt, Artificial Sequence
  Synthetic
aacaacacagaauccacug

SEQ ID NO: 5576 - RNA, 19 nt, Artificial Sequence
  Synthetic
ccugucaccagcccgaagg

SEQ ID NO: 5577 - RNA, 19 nt, Artificial Sequence
  Synthetic
acaaauugcugcugugucc

SEQ ID NO: 5578 - RNA, 19 nt, Artificial Sequence
  Synthetic
cauggacguacggcgcugg

SEQ ID NO: 5579 - RNA, 19 nt, Artificial Sequence
  Synthetic
caacugaaagccguuucuu

SEQ ID NO: 5580 - RNA, 19 nt, Artificial Sequence
  Synthetic
cugcaugcccucaucuaau

SEQ ID NO: 5581 - RNA, 19 nt, Artificial Sequence
  Synthetic
uucugaagagagagcuggu

SEQ ID NO: 5582 - RNA, 19 nt, Artificial Sequence
  Synthetic
aagcugauggaccauaacu

SEQ ID NO: 5583 - RNA, 19 nt, Artificial Sequence
  Synthetic
gcccaucaacuggauaguc

SEQ ID NO: 5584 - RNA, 19 nt, Artificial Sequence
  Synthetic
ccacuggugaaccaagcau

SEQ ID NO: 5585 - RNA, 19 nt, Artificial Sequence
  Synthetic
ugugaacaucccgagcuag

SEQ ID NO: 5586 - RNA, 19 nt, Artificial Sequence
  Synthetic
gggaugguggguguaagag

SEQ ID NO: 5587 - RNA, 19 nt, Artificial Sequence
  Synthetic
cuuccuuguccugagcaag

SEQ ID NO: 5588 - RNA, 19 nt, Artificial Sequence
  Synthetic
aagccguuucuuguaaucu

SEQ ID NO: 5589 - RNA, 19 nt, Artificial Sequence
  Synthetic
ucagagaaggagcuguggu

SEQ ID NO: 5590 - RNA, 19 nt, Artificial Sequence
  Synthetic
cuguuuaguugcagcaucu

SEQ ID NO: 5591 - RNA, 19 nt, Artificial Sequence
  Synthetic
gguggguguaagagcuuaa

SEQ ID NO: 5592 - RNA, 19 nt, Artificial Sequence
  Synthetic
ccauaacugcagccuuauu

SEQ ID NO: 5593 - RNA, 19 nt, Artificial Sequence
  Synthetic
cuacccauacauaucccaa

SEQ ID NO: 5594 - RNA, 19 nt, Artificial Sequence
  Synthetic
ucguaucacagcagguuac

SEQ ID NO: 5595 - RNA, 19 nt, Artificial Sequence
  Synthetic
ccacccacuuggcagacca

SEQ ID NO: 5596 - RNA, 19 nt, Artificial Sequence
  Synthetic
cuuuaccacucagagaagg

SEQ ID NO: 5597 - RNA, 19 nt, Artificial Sequence
  Synthetic
ccucagcuucaauagcuuc

SEQ ID NO: 5598 - RNA, 19 nt, Artificial Sequence
  Synthetic
cguguggcaaguucugcau

SEQ ID NO: 5599 - RNA, 19 nt, Artificial Sequence
  Synthetic
guccaucaauaucagcuac

SEQ ID NO: 5600 - RNA, 19 nt, Artificial Sequence
  Synthetic
uccaucaaaucagcuugag

SEQ ID NO: 5601 - RNA, 19 nt, Artificial Sequence
  Synthetic
ucaacuauuucuuccaugc

SEQ ID NO: 5602 - RNA, 19 nt, Artificial Sequence
  Synthetic
aaagcuugcauuccaccag

SEQ ID NO: 5603 - RNA, 19 nt, Artificial Sequence
  Synthetic
ccauccaugagguccuggg

SEQ ID NO: 5604 - RNA, 19 nt, Artificial Sequence
  Synthetic
uacccauacauaucccaaa

SEQ ID NO: 5605 - RNA, 19 nt, Artificial Sequence
  Synthetic
gcagguuacaacaacuuug

SEQ ID NO: 5606 - RNA, 19 nt, Artificial Sequence
  Synthetic
uccucugauaacaauucgg

SEQ ID NO: 5607 - RNA, 19 nt, Artificial Sequence
  Synthetic
uuuauucagauuacaauua

SEQ ID NO: 5608 - RNA, 19 nt, Artificial Sequence
  Synthetic
acuuuauucagauuacaau

SEQ ID NO: 5609 - RNA, 19 nt, Artificial Sequence
  Synthetic
guccucugauaacaauucg

SEQ ID NO: 5610 - RNA, 19 nt, Artificial Sequence
  Synthetic
ccacucauacaggacuugg

SEQ ID NO: 5611 - RNA, 19 nt, Artificial Sequence
  Synthetic
cuucuacaauagccggcuu

SEQ ID NO: 5612 - RNA, 19 nt, Artificial Sequence
  Synthetic
aaagaacgauagcuaggau

SEQ ID NO: 5613 - RNA, 19 nt, Artificial Sequence
  Synthetic
cgaugaugggaaagguuau

SEQ ID NO: 5614 - RNA, 19 nt, Artificial Sequence
  Synthetic
ucuauaccacccacuuggc

SEQ ID NO: 5615 - RNA, 19 nt, Artificial Sequence
  Synthetic
caagcaacugaacuagucg

SEQ ID NO: 5616 - RNA, 19 nt, Artificial Sequence
  Synthetic
gaauccacuggugaaccaa

SEQ ID NO: 5617 - RNA, 19 nt, Artificial Sequence
  Synthetic
uccaaagacaguucugaac

SEQ ID NO: 5618 - RNA, 19 nt, Artificial Sequence
  Synthetic
gaagcaucguaucacagca

SEQ ID NO: 5619 - RNA, 19 nt, Artificial Sequence
  Synthetic
cugauugcugucaccugga

SEQ ID NO: 5620 - RNA, 19 nt, Artificial Sequence
  Synthetic
agaaagcugauggaccaua

SEQ ID NO: 5621 - RNA, 19 nt, Artificial Sequence
  Synthetic
aacuagucguggaauggca

SEQ ID NO: 5622 - RNA, 19 nt, Artificial Sequence
  Synthetic
ugagcuugcuuucuugguu

SEQ ID NO: 5623 - RNA, 19 nt, Artificial Sequence
  Synthetic
aucuuguucuuauaauuau

SEQ ID NO: 5624 - RNA, 19 nt, Artificial Sequence
  Synthetic
guggguguaagagcuuaac

SEQ ID NO: 5625 - RNA, 19 nt, Artificial Sequence
  Synthetic
guucuacaccauuacucaa

SEQ ID NO: 5626 - RNA, 19 nt, Artificial Sequence
  Synthetic
gcugcauaugucgccacac

SEQ ID NO: 5627 - RNA, 19 nt, Artificial Sequence
  Synthetic
ucugaagagagagcugguc

SEQ ID NO: 5628 - RNA, 19 nt, Artificial Sequence
  Synthetic
gugaagggcuccgguacaa

SEQ ID NO: 5629 - RNA, 19 nt, Artificial Sequence
  Synthetic
ugucugguuccauggccau

SEQ ID NO: 5630 - RNA, 19 nt, Artificial Sequence
  Synthetic
auccuggccauauccacca

SEQ ID NO: 5631 - RNA, 19 nt, Artificial Sequence
  Synthetic
gaaguaacucugucagagg

SEQ ID NO: 5632 - RNA, 19 nt, Artificial Sequence
  Synthetic
gaacgauagcuaggaucau

SEQ ID NO: 5633 - RNA, 19 nt, Artificial Sequence
  Synthetic
uagaaagcugauggaccau

SEQ ID NO: 5634 - RNA, 19 nt, Artificial Sequence
  Synthetic
agaagcugaacaagagucc

SEQ ID NO: 5635 - RNA, 19 nt, Artificial Sequence
  Synthetic
gaggagaacgcaugauagc

SEQ ID NO: 5636 - RNA, 19 nt, Artificial Sequence
  Synthetic
gaagagagagcuggucagc

SEQ ID NO: 5637 - RNA, 19 nt, Artificial Sequence
  Synthetic
gguauccugaugugcacga

SEQ ID NO: 5638 - RNA, 19 nt, Artificial Sequence
  Synthetic
ucauuccuagagugaagua

SEQ ID NO: 5639 - RNA, 19 nt, Artificial Sequence
  Synthetic
uuuacaacugcauguuuca

SEQ ID NO: 5640 - RNA, 19 nt, Artificial Sequence
  Synthetic
ggagaguuguaauggcaua

SEQ ID NO: 5641 - RNA, 19 nt, Artificial Sequence
  Synthetic
auuuaguccucugauaaca

SEQ ID NO: 5642 - RNA, 19 nt, Artificial Sequence
  Synthetic
cccaaggagaccuuccauc

SEQ ID NO: 5643 - RNA, 19 nt, Artificial Sequence
  Synthetic
ugcagcuacucuuuggaug

SEQ ID NO: 5644 - RNA, 19 nt, Artificial Sequence
  Synthetic
ucugcuucuuggugucggc

SEQ ID NO: 5645 - RNA, 19 nt, Artificial Sequence
  Synthetic
gauuccugagaguccaaag

SEQ ID NO: 5646 - RNA, 19 nt, Artificial Sequence
  Synthetic
gccacccaucucauguucc

SEQ ID NO: 5647 - RNA, 19 nt, Artificial Sequence
  Synthetic
ccagcuaaacgcacugcca

SEQ ID NO: 5648 - RNA, 19 nt, Artificial Sequence
  Synthetic
aauagcuucugcagcuucc

SEQ ID NO: 5649 - RNA, 19 nt, Artificial Sequence
  Synthetic
cacaccuucauuccuagag

SEQ ID NO: 5650 - RNA, 19 nt, Artificial Sequence
  Synthetic
ggaacauagcagcucguac

SEQ ID NO: 5651 - RNA, 19 nt, Artificial Sequence
  Synthetic
caacugaacuagucgugga

SEQ ID NO: 5652 - RNA, 19 nt, Artificial Sequence
  Synthetic
uagcagacaccaucugagg

SEQ ID NO: 5653 - RNA, 19 nt, Artificial Sequence
  Synthetic
ccugagcaaguucacagag

SEQ ID NO: 5654 - RNA, 19 nt, Artificial Sequence
  Synthetic
gcugauggaccauaacugc

SEQ ID NO: 5655 - RNA, 19 nt, Artificial Sequence
  Synthetic
ugggaugguggguguaaga

SEQ ID NO: 5656 - RNA, 19 nt, Artificial Sequence
  Synthetic
agcuaggaucauccuggcg

SEQ ID NO: 5657 - RNA, 19 nt, Artificial Sequence
  Synthetic
gacuuggaucugucaggug

SEQ ID NO: 5658 - RNA, 19 nt, Artificial Sequence
  Synthetic
auuccagcugcacagguga

SEQ ID NO: 5659 - RNA, 19 nt, Artificial Sequence
  Synthetic
accuggaggcagcccaucc

SEQ ID NO: 5660 - RNA, 19 nt, Artificial Sequence
  Synthetic
gaugugaagggcuccggua

SEQ ID NO: 5661 - RNA, 19 nt, Artificial Sequence
  Synthetic
gcccucaucuaaugucuca

SEQ ID NO: 5662 - RNA, 19 nt, Artificial Sequence
  Synthetic
caccuucauuccuagagug

SEQ ID NO: 5663 - RNA, 19 nt, Artificial Sequence
  Synthetic
gugggaugagcagcaucaa

SEQ ID NO: 5664 - RNA, 19 nt, Artificial Sequence
  Synthetic
gccuuuaccacucagagaa

SEQ ID NO: 5665 - RNA, 19 nt, Artificial Sequence
  Synthetic
uugcugccagugacuaaca

SEQ ID NO: 5666 - RNA, 19 nt, Artificial Sequence
  Synthetic
aaccuucaacuauuucuuc

SEQ ID NO: 5667 - RNA, 19 nt, Artificial Sequence
  Synthetic
cuucauuccuagagugaag

SEQ ID NO: 5668 - RNA, 19 nt, Artificial Sequence
  Synthetic
uuauaucaucugaacccag

SEQ ID NO: 5669 - RNA, 19 nt, Artificial Sequence
  Synthetic
guaaucuuguggcuugucc

SEQ ID NO: 5670 - RNA, 19 nt, Artificial Sequence
  Synthetic
ggauagucagcaccagggu

SEQ ID NO: 5671 - RNA, 19 nt, Artificial Sequence
  Synthetic
cccugggcaccaauaucaa

SEQ ID NO: 5672 - RNA, 19 nt, Artificial Sequence
  Synthetic
cauacaggacuugggaggu

SEQ ID NO: 5673 - RNA, 19 nt, Artificial Sequence
  Synthetic
agcucgagucauugcauac

SEQ ID NO: 5674 - RNA, 19 nt, Artificial Sequence
  Synthetic
agagcuuaaccacaacugg

SEQ ID NO: 5675 - RNA, 19 nt, Artificial Sequence
  Synthetic
cccucugagcucgagucau

SEQ ID NO: 5676 - RNA, 19 nt, Artificial Sequence
  Synthetic
ucacagcagguuacaacaa

SEQ ID NO: 5677 - RNA, 19 nt, Artificial Sequence
  Synthetic
gaacaagacguugacuugg

SEQ ID NO: 5678 - RNA, 19 nt, Artificial Sequence
  Synthetic
ugguauuuaguccucugau

SEQ ID NO: 5679 - RNA, 19 nt, Artificial Sequence
  Synthetic
gauuuacccuacccauaca

SEQ ID NO: 5680 - RNA, 19 nt, Artificial Sequence
  Synthetic
gaauggcacccugcucacg

SEQ ID NO: 5681 - RNA, 19 nt, Artificial Sequence
  Synthetic
cagaucuggcagcccauca

SEQ ID NO: 5682 - RNA, 19 nt, Artificial Sequence
  Synthetic
ccugaugugcacgaacaag

SEQ ID NO: 5683 - RNA, 19 nt, Artificial Sequence
  Synthetic
guuucagcaucugugaugg

SEQ ID NO: 5684 - RNA, 19 nt, Artificial Sequence
  Synthetic
aaggcaacugguaaacugu

SEQ ID NO: 5685 - RNA, 19 nt, Artificial Sequence
  Synthetic
ccucugauaacaauucggu

SEQ ID NO: 5686 - RNA, 19 nt, Artificial Sequence
  Synthetic
caccagcuaaacgcacugc

SEQ ID NO: 5687 - RNA, 19 nt, Artificial Sequence
  Synthetic
uggccacccaucucauguu

SEQ ID NO: 5688 - RNA, 19 nt, Artificial Sequence
  Synthetic
uugacuuggaucugucagg

SEQ ID NO: 5689 - RNA, 19 nt, Artificial Sequence
  Synthetic
auucgguugugaacauccc

SEQ ID NO: 5690 - RNA, 19 nt, Artificial Sequence
  Synthetic
caagauuucgaaucaaucc

SEQ ID NO: 5691 - RNA, 19 nt, Artificial Sequence
  Synthetic
caauagcuucugcagcuuc

SEQ ID NO: 5692 - RNA, 19 nt, Artificial Sequence
  Synthetic
ccucugagcucgagucauu

SEQ ID NO: 5693 - RNA, 19 nt, Artificial Sequence
  Synthetic
gaacccagaagcugaacaa

SEQ ID NO: 5694 - RNA, 19 nt, Artificial Sequence
  Synthetic
auaauuauugcaagugagg

SEQ ID NO: 5695 - RNA, 19 nt, Artificial Sequence
  Synthetic
caauagcagacaccaucug

SEQ ID NO: 5696 - RNA, 19 nt, Artificial Sequence
  Synthetic
uacuuguucuugagugaag

SEQ ID NO: 5697 - RNA, 19 nt, Artificial Sequence
  Synthetic
auguuucagcaucugugau

SEQ ID NO: 5698 - RNA, 19 nt, Artificial Sequence
  Synthetic
uccauagugaaggcgaacu

SEQ ID NO: 5699 - RNA, 19 nt, Artificial Sequence
  Synthetic
gacuuaaagauggccagua

SEQ ID NO: 5700 - RNA, 19 nt, Artificial Sequence
  Synthetic
uuauauuuacuaaagcuug

SEQ ID NO: 5701 - RNA, 19 nt, Artificial Sequence
  Synthetic
uucuuguaaucuuguggcu

SEQ ID NO: 5702 - RNA, 19 nt, Artificial Sequence
  Synthetic
uucugggccaucucugcuu

SEQ ID NO: 5703 - RNA, 19 nt, Artificial Sequence
  Synthetic
guguggcaaguucugcauc

SEQ ID NO: 5704 - RNA, 19 nt, Artificial Sequence
  Synthetic
guugcagcaucugaaagau

SEQ ID NO: 5705 - RNA, 19 nt, Artificial Sequence
  Synthetic
aaauugcugcuguguccca

SEQ ID NO: 5706 - RNA, 19 nt, Artificial Sequence
  Synthetic
gacguugacuuggaucugu

SEQ ID NO: 5707 - RNA, 19 nt, Artificial Sequence
  Synthetic
cuccacaaauugcugcugu

SEQ ID NO: 5708 - RNA, 19 nt, Artificial Sequence
  Synthetic
cccuuccuguuuaguugca

SEQ ID NO: 5709 - RNA, 19 nt, Artificial Sequence
  Synthetic
cagcuuccuuguccugagc

SEQ ID NO: 5710 - RNA, 19 nt, Artificial Sequence
  Synthetic
aauggaaugguauuuaguc

SEQ ID NO: 5711 - RNA, 19 nt, Artificial Sequence
  Synthetic
ugggaugagcagcaucaaa

SEQ ID NO: 5712 - RNA, 19 nt, Artificial Sequence
  Synthetic
gguaagacuguugcugcca

SEQ ID NO: 5713 - RNA, 19 nt, Artificial Sequence
  Synthetic
augaugagcuugcuuucuu

SEQ ID NO: 5714 - RNA, 19 nt, Artificial Sequence
  Synthetic
aauaucaaguccaagauca

SEQ ID NO: 5715 - RNA, 19 nt, Artificial Sequence
  Synthetic
auuguuacacuuuauucag

SEQ ID NO: 5716 - RNA, 19 nt, Artificial Sequence
  Synthetic
caauggaaugguauuuagu

SEQ ID NO: 5717 - RNA, 19 nt, Artificial Sequence
  Synthetic
cgcuggacauuagugggau

SEQ ID NO: 5718 - RNA, 19 nt, Artificial Sequence
  Synthetic
gaaggagcugugguagugg

SEQ ID NO: 5719 - RNA, 19 nt, Artificial Sequence
  Synthetic
ggcgcuggguauccugaug

SEQ ID NO: 5720 - RNA, 19 nt, Artificial Sequence
  Synthetic
cauguuucagcaucuguga

SEQ ID NO: 5721 - RNA, 19 nt, Artificial Sequence
  Synthetic
ggcacccugcucacgcaaa

SEQ ID NO: 5722 - RNA, 19 nt, Artificial Sequence
  Synthetic
uaucaaguccaagaucagc

SEQ ID NO: 5723 - RNA, 19 nt, Artificial Sequence
  Synthetic
gcagucugucguaauagcc

SEQ ID NO: 5724 - RNA, 19 nt, Artificial Sequence
  Synthetic
ugguuccauggccaugucc

SEQ ID NO: 5725 - RNA, 19 nt, Artificial Sequence
  Synthetic
ggcagaccaucaucuuguu

SEQ ID NO: 5726 - RNA, 19 nt, Artificial Sequence
  Synthetic
uagcuccuucuugauguaa

SEQ ID NO: 5727 - RNA, 19 nt, Artificial Sequence
  Synthetic
cacgcaaaggugcaugauu

SEQ ID NO: 5728 - RNA, 19 nt, Artificial Sequence
  Synthetic
gcaaaggugcaugauuugc

SEQ ID NO: 5729 - RNA, 19 nt, Artificial Sequence
  Synthetic
aggauugccuuuaccacuc

SEQ ID NO: 5730 - RNA, 19 nt, Artificial Sequence
  Synthetic
uaguccauagugaaggcga

SEQ ID NO: 5731 - RNA, 19 nt, Artificial Sequence
  Synthetic
uaguggcaccagaauggau

SEQ ID NO: 5732 - RNA, 19 nt, Artificial Sequence
  Synthetic
cggcgcuggguauccugau

SEQ ID NO: 5733 - RNA, 19 nt, Artificial Sequence
  Synthetic
gcucgagucauugcauacu

SEQ ID NO: 5734 - RNA, 19 nt, Artificial Sequence
  Synthetic
ucagcucaacugaaagccg

SEQ ID NO: 5735 - RNA, 19 nt, Artificial Sequence
  Synthetic
gauggaccauaacugcagc

SEQ ID NO: 5736 - RNA, 19 nt, Artificial Sequence
  Synthetic
uucuacaccauuacucaau

SEQ ID NO: 5737 - RNA, 19 nt, Artificial Sequence
  Synthetic
uacacuuuauucagauuac

SEQ ID NO: 5738 - RNA, 19 nt, Artificial Sequence
  Synthetic
auugcauacuguccaucaa

SEQ ID NO: 5739 - RNA, 19 nt, Artificial Sequence
  Synthetic
uacccuacccauacauauc

SEQ ID NO: 5740 - RNA, 19 nt, Artificial Sequence
  Synthetic
gcagaccaucaucuuguuc

SEQ ID NO: 5741 - RNA, 19 nt, Artificial Sequence
  Synthetic
guauuuaguccucugauaa

SEQ ID NO: 5742 - RNA, 19 nt, Artificial Sequence
  Synthetic
cacagaauccacuggugaa

SEQ ID NO: 5743 - RNA, 19 nt, Artificial Sequence
  Synthetic
agggcuccgguacaaccuu

SEQ ID NO: 5744 - RNA, 19 nt, Artificial Sequence
  Synthetic
gcauuccaccagcuucuac

SEQ ID NO: 5745 - RNA, 19 nt, Artificial Sequence
  Synthetic
uccuguuuaguugcagcau

SEQ ID NO: 5746 - RNA, 19 nt, Artificial Sequence
  Synthetic
gccauauccaccagaguga

SEQ ID NO: 5747 - RNA, 19 nt, Artificial Sequence
  Synthetic
uccaacuccaucaaaucag

SEQ ID NO: 5748 - RNA, 19 nt, Artificial Sequence
  Synthetic
ccacuagccaguaugauga

SEQ ID NO: 5749 - RNA, 19 nt, Artificial Sequence
  Synthetic
cugaugugcacgaacaagc

SEQ ID NO: 5750 - RNA, 19 nt, Artificial Sequence
  Synthetic
ggcuuauuacuagagcaga

SEQ ID NO: 5751 - RNA, 19 nt, Artificial Sequence
  Synthetic
uuacuagagcagacagaua

SEQ ID NO: 5752 - RNA, 19 nt, Artificial Sequence
  Synthetic
gccaguaugaugagcuugc

SEQ ID NO: 5753 - RNA, 19 nt, Artificial Sequence
  Synthetic
auagcagcucguacccucu

SEQ ID NO: 5754 - RNA, 19 nt, Artificial Sequence
  Synthetic
ccgaaggacaguacgcaca

SEQ ID NO: 5755 - RNA, 19 nt, Artificial Sequence
  Synthetic
gagaccuuccaucccuucc

SEQ ID NO: 5756 - RNA, 19 nt, Artificial Sequence
  Synthetic
ccaucugaggagaacgcau

SEQ ID NO: 5757 - RNA, 19 nt, Artificial Sequence
  Synthetic
agagugaaguaacucuguc

SEQ ID NO: 5758 - RNA, 19 nt, Artificial Sequence
  Synthetic
agucugucguaauagccaa

SEQ ID NO: 5759 - RNA, 19 nt, Artificial Sequence
  Synthetic
uaaccacaacugguagucc

SEQ ID NO: 5760 - RNA, 19 nt, Artificial Sequence
  Synthetic
guccaaagacaguucugaa

SEQ ID NO: 5761 - RNA, 19 nt, Artificial Sequence
  Synthetic
uggugucggcuggucagau

SEQ ID NO: 5762 - RNA, 19 nt, Artificial Sequence
  Synthetic
ccacaaauugcugcugugu

SEQ ID NO: 5763 - RNA, 19 nt, Artificial Sequence
  Synthetic
cagagaaggagcuguggua

SEQ ID NO: 5764 - RNA, 19 nt, Artificial Sequence
  Synthetic
ugugucccacccauggacg

SEQ ID NO: 5765 - RNA, 19 nt, Artificial Sequence
  Synthetic
guguaagagcuuaaccaca

SEQ ID NO: 5766 - RNA, 19 nt, Artificial Sequence
  Synthetic
uucugcaugguacguacaa

SEQ ID NO: 5767 - RNA, 19 nt, Artificial Sequence
  Synthetic
acguacggcgcuggguauc

SEQ ID NO: 5768 - RNA, 19 nt, Artificial Sequence
  Synthetic
aucugaggagaacgcauga

SEQ ID NO: 5769 - RNA, 19 nt, Artificial Sequence
  Synthetic
gcuggguauccugaugugc

SEQ ID NO: 5770 - RNA, 19 nt, Artificial Sequence
  Synthetic
aaagccguuucuuguaauc

SEQ ID NO: 5771 - RNA, 19 nt, Artificial Sequence
  Synthetic
cuuaaccacaacugguagu

SEQ ID NO: 5772 - RNA, 19 nt, Artificial Sequence
  Synthetic
agacaguucugaacaagac

SEQ ID NO: 5773 - RNA, 19 nt, Artificial Sequence
  Synthetic
gugucggcuggucagauga

SEQ ID NO: 5774 - RNA, 19 nt, Artificial Sequence
  Synthetic
gcacccugcucacgcaaag

SEQ ID NO: 5775 - RNA, 19 nt, Artificial Sequence
  Synthetic
ccugagaguccaaagacag

SEQ ID NO: 5776 - RNA, 19 nt, Artificial Sequence
  Synthetic
uuagcuccuucuugaugua

SEQ ID NO: 5777 - RNA, 19 nt, Artificial Sequence
  Synthetic
aagacguugacuuggaucu

SEQ ID NO: 5778 - RNA, 19 nt, Artificial Sequence
  Synthetic
ugaacaagacguugacuug

SEQ ID NO: 5779 - RNA, 19 nt, Artificial Sequence
  Synthetic
ugaacaagagucccaagga

SEQ ID NO: 5780 - RNA, 19 nt, Artificial Sequence
  Synthetic
cuaaagcuugcauuccacc

SEQ ID NO: 5781 - RNA, 19 nt, Artificial Sequence
  Synthetic
ccuuccuguuuaguugcag

SEQ ID NO: 5782 - RNA, 19 nt, Artificial Sequence
  Synthetic
cugucaggugaaguccuaa

SEQ ID NO: 5783 - RNA, 19 nt, Artificial Sequence
  Synthetic
uccaucaauaucagcuacu

SEQ ID NO: 5784 - RNA, 19 nt, Artificial Sequence
  Synthetic
aguauagguccucauuaua

SEQ ID NO: 5785 - RNA, 19 nt, Artificial Sequence
  Synthetic
agcaucguaucacagcagg

SEQ ID NO: 5786 - RNA, 19 nt, Artificial Sequence
  Synthetic
cagggugguggccacccau

SEQ ID NO: 5787 - RNA, 19 nt, Artificial Sequence
  Synthetic
ugaaagauuccugagaguc

SEQ ID NO: 5788 - RNA, 19 nt, Artificial Sequence
  Synthetic
uggguauccugaugugcac

SEQ ID NO: 5789 - RNA, 19 nt, Artificial Sequence
  Synthetic
caugauagcgugucuggaa

SEQ ID NO: 5790 - RNA, 19 nt, Artificial Sequence
  Synthetic
gggauugcacguguggcaa

SEQ ID NO: 5791 - RNA, 19 nt, Artificial Sequence
  Synthetic
guuuaguugcagcaucuga

SEQ ID NO: 5792 - RNA, 19 nt, Artificial Sequence
  Synthetic
gucaggugaaguccuaaag

SEQ ID NO: 5793 - RNA, 19 nt, Artificial Sequence
  Synthetic
gcucacgcaaaggugcaug

SEQ ID NO: 5794 - RNA, 19 nt, Artificial Sequence
  Synthetic
aaagguuguggagaguugu

SEQ ID NO: 5795 - RNA, 19 nt, Artificial Sequence
  Synthetic
aagcugaacaagaguccca

SEQ ID NO: 5796 - RNA, 19 nt, Artificial Sequence
  Synthetic
auccacuggugaaccaagc

SEQ ID NO: 5797 - RNA, 19 nt, Artificial Sequence
  Synthetic
gcccucacgaugaugggaa

SEQ ID NO: 5798 - RNA, 19 nt, Artificial Sequence
  Synthetic
gcuuauuacuagagcagac

SEQ ID NO: 5799 - RNA, 19 nt, Artificial Sequence
  Synthetic
caucugaacccagaagcug

SEQ ID NO: 5800 - RNA, 19 nt, Artificial Sequence
  Synthetic
gucggcuggucagaugacg

SEQ ID NO: 5801 - RNA, 19 nt, Artificial Sequence
  Synthetic
ucuaaugucucagggaaca

SEQ ID NO: 5802 - RNA, 19 nt, Artificial Sequence
  Synthetic
agcuugcuuucuugguugc

SEQ ID NO: 5803 - RNA, 19 nt, Artificial Sequence
  Synthetic
cauggccauguccaacucc

SEQ ID NO: 5804 - RNA, 19 nt, Artificial Sequence
  Synthetic
cuauuucuuccaugcggac

SEQ ID NO: 5805 - RNA, 19 nt, Artificial Sequence
  Synthetic
auaucaaguccaagaucag

SEQ ID NO: 5806 - RNA, 19 nt, Artificial Sequence
  Synthetic
ucccaaggagaccuuccau

SEQ ID NO: 5807 - RNA, 19 nt, Artificial Sequence
  Synthetic
acccacuuggcagaccauc

SEQ ID NO: 5808 - RNA, 19 nt, Artificial Sequence
  Synthetic
ucugcaucaucuugauagu

SEQ ID NO: 5809 - RNA, 19 nt, Artificial Sequence
  Synthetic
ugcauguuucagcaucugu

SEQ ID NO: 5810 - RNA, 19 nt, Artificial Sequence
  Synthetic
gcuggucagcucaacugaa

SEQ ID NO: 5811 - RNA, 19 nt, Artificial Sequence
  Synthetic
aguacgcacaagagccucu

SEQ ID NO: 5812 - RNA, 19 nt, Artificial Sequence
  Synthetic
cauccuggccauauccacc

SEQ ID NO: 5813 - RNA, 19 nt, Artificial Sequence
  Synthetic
ggauugcacguguggcaag

SEQ ID NO: 5814 - RNA, 19 nt, Artificial Sequence
  Synthetic
gugaaggcgaacugcauuc

SEQ ID NO: 5815 - RNA, 19 nt, Artificial Sequence
  Synthetic
gugaacaucccgagcuagg

SEQ ID NO: 5816 - RNA, 19 nt, Artificial Sequence
  Synthetic
acugguaguccauagugaa

SEQ ID NO: 5817 - RNA, 19 nt, Artificial Sequence
  Synthetic
agggugguggccacccauc

SEQ ID NO: 5818 - RNA, 19 nt, Artificial Sequence
  Synthetic
acugcagccuuauuaacca

SEQ ID NO: 5819 - RNA, 19 nt, Artificial Sequence
  Synthetic
aguucugcaucaucuugau

SEQ ID NO: 5820 - RNA, 19 nt, Artificial Sequence
  Synthetic
aagcaucguaucacagcag

SEQ ID NO: 5821 - RNA, 19 nt, Artificial Sequence
  Synthetic
ggguccauacccaaggcau

SEQ ID NO: 5822 - RNA, 19 nt, Artificial Sequence
  Synthetic
cuugaagcaucguaucaca

SEQ ID NO: 5823 - RNA, 19 nt, Artificial Sequence
  Synthetic
gauagcaccuucagcacuc

SEQ ID NO: 5824 - RNA, 19 nt, Artificial Sequence
  Synthetic
cauagcagcucguacccuc

SEQ ID NO: 5825 - RNA, 19 nt, Artificial Sequence
  Synthetic
uuauucagauuacaauuaa

SEQ ID NO: 5826 - RNA, 19 nt, Artificial Sequence
  Synthetic
ccaucucugcuucuuggug

SEQ ID NO: 5827 - RNA, 19 nt, Artificial Sequence
  Synthetic
aguccuaaagcuugcauuc

SEQ ID NO: 5828 - RNA, 19 nt, Artificial Sequence
  Synthetic
acccugcucacgcaaaggu

SEQ ID NO: 5829 - RNA, 19 nt, Artificial Sequence
  Synthetic
gagcagacagauagcaccu

SEQ ID NO: 5830 - RNA, 19 nt, Artificial Sequence
  Synthetic
gcuuccuuguccugagcaa

SEQ ID NO: 5831 - RNA, 19 nt, Artificial Sequence
  Synthetic
gagcuguggcucccucagc

SEQ ID NO: 5832 - RNA, 19 nt, Artificial Sequence
  Synthetic
agagaaggagcugugguag

SEQ ID NO: 5833 - RNA, 19 nt, Artificial Sequence
  Synthetic
ccacccaucucauguucca

SEQ ID NO: 5834 - RNA, 19 nt, Artificial Sequence
  Synthetic
gcaugguacguacaauagc

SEQ ID NO: 5835 - RNA, 19 nt, Artificial Sequence
  Synthetic
ugcgggacaaagggcaaga

SEQ ID NO: 5836 - RNA, 19 nt, Artificial Sequence
  Synthetic
caucaucuuguucuuauaa

SEQ ID NO: 5837 - RNA, 19 nt, Artificial Sequence
  Synthetic
agcgugucuggaagcuucc

SEQ ID NO: 5838 - RNA, 19 nt, Artificial Sequence
  Synthetic
uucuacaauagccggcuua

SEQ ID NO: 5839 - RNA, 19 nt, Artificial Sequence
  Synthetic
auuaaccaccaccuggucc

SEQ ID NO: 5840 - RNA, 19 nt, Artificial Sequence
  Synthetic
uacuguccaucaauaucag

SEQ ID NO: 5841 - RNA, 19 nt, Artificial Sequence
  Synthetic
uacugauuuacccuaccca

SEQ ID NO: 5842 - RNA, 19 nt, Artificial Sequence
  Synthetic
cugggcaccaauaucaagu

SEQ ID NO: 5843 - RNA, 19 nt, Artificial Sequence
  Synthetic
ugguggguguaagagcuua

SEQ ID NO: 5844 - RNA, 19 nt, Artificial Sequence
  Synthetic
aucaaaucagcuugaguag

SEQ ID NO: 5845 - RNA, 19 nt, Artificial Sequence
  Synthetic
cuagucguggaauggcacc

SEQ ID NO: 5846 - RNA, 19 nt, Artificial Sequence
  Synthetic
guuccauggccauguccaa

SEQ ID NO: 5847 - RNA, 19 nt, Artificial Sequence
  Synthetic
acauuagugggaugagcag

SEQ ID NO: 5848 - RNA, 19 nt, Artificial Sequence
  Synthetic
gucugguuccauggccaug

SEQ ID NO: 5849 - RNA, 19 nt, Artificial Sequence
  Synthetic
ugcuuucuugguugccaua

SEQ ID NO: 5850 - RNA, 19 nt, Artificial Sequence
  Synthetic
caacacagaauccacuggu

SEQ ID NO: 5851 - RNA, 19 nt, Artificial Sequence
  Synthetic
uagagugaaguaacucugu

SEQ ID NO: 5852 - RNA, 19 nt, Artificial Sequence
  Synthetic
ucugucaggugaaguccua

SEQ ID NO: 5853 - RNA, 19 nt, Artificial Sequence
  Synthetic
auacccaaggcauccuggc

SEQ ID NO: 5854 - RNA, 19 nt, Artificial Sequence
  Synthetic
guaaguauagguccucauu

SEQ ID NO: 5855 - RNA, 19 nt, Artificial Sequence
  Synthetic
ugucguaauagccaagaau

SEQ ID NO: 5856 - RNA, 19 nt, Artificial Sequence
  Synthetic
uuucaaugggagaauaaag

SEQ ID NO: 5857 - RNA, 19 nt, Artificial Sequence
  Synthetic
uguccaucaauaucagcua

SEQ ID NO: 5858 - RNA, 19 nt, Artificial Sequence
  Synthetic
gagaguccaaagacaguuc

SEQ ID NO: 5859 - RNA, 19 nt, Artificial Sequence
  Synthetic
uguugcugccagugacuaa

SEQ ID NO: 5860 - RNA, 19 nt, Artificial Sequence
  Synthetic
uuguggagaguuguaaugg

SEQ ID NO: 5861 - RNA, 19 nt, Artificial Sequence
  Synthetic
gguguaagagcuuaaccac

SEQ ID NO: 5862 - RNA, 19 nt, Artificial Sequence
  Synthetic
guccaacuccaucaaauca

SEQ ID NO: 5863 - RNA, 19 nt, Artificial Sequence
  Synthetic
cauucugggccaucucugc

SEQ ID NO: 5864 - RNA, 19 nt, Artificial Sequence
  Synthetic
ccaucccuuccuguuuagu

SEQ ID NO: 5865 - RNA, 19 nt, Artificial Sequence
  Synthetic
ccaagaauuuaacauuugu

SEQ ID NO: 5866 - RNA, 19 nt, Artificial Sequence
  Synthetic
ucugagcucgagucauugc

SEQ ID NO: 5867 - RNA, 19 nt, Artificial Sequence
  Synthetic
cgguugugaacaucccgag

SEQ ID NO: 5868 - RNA, 19 nt, Artificial Sequence
  Synthetic
uacguacaauagcagacac

SEQ ID NO: 5869 - RNA, 19 nt, Artificial Sequence
  Synthetic
gacuugggagguauccaca

SEQ ID NO: 5870 - RNA, 19 nt, Artificial Sequence
  Synthetic
guccauacccaaggcaucc

SEQ ID NO: 5871 - RNA, 19 nt, Artificial Sequence
  Synthetic
ucguaauagccaagaauuu

SEQ ID NO: 5872 - RNA, 19 nt, Artificial Sequence
  Synthetic
gggaacauagcagcucgua

SEQ ID NO: 5873 - RNA, 19 nt, Artificial Sequence
  Synthetic
ccaccagcuaaacgcacug

SEQ ID NO: 5874 - RNA, 19 nt, Artificial Sequence
  Synthetic
caaguucugcaucaucuug

SEQ ID NO: 5875 - RNA, 19 nt, Artificial Sequence
  Synthetic
cgagcuguuucuacaucau

SEQ ID NO: 5876 - RNA, 19 nt, Artificial Sequence
  Synthetic
ggagaauaaagcagcugca

SEQ ID NO: 5877 - RNA, 19 nt, Artificial Sequence
  Synthetic
cucagagaaggagcugugg

SEQ ID NO: 5878 - RNA, 19 nt, Artificial Sequence
  Synthetic
ccauagugaaggcgaacug

SEQ ID NO: 5879 - RNA, 19 nt, Artificial Sequence
  Synthetic
auagcgugucuggaagcuu

SEQ ID NO: 5880 - RNA, 19 nt, Artificial Sequence
  Synthetic
cuggucagcucaacugaaa

SEQ ID NO: 5881 - RNA, 19 nt, Artificial Sequence
  Synthetic
cugugguaguggcaccaga

SEQ ID NO: 5882 - RNA, 19 nt, Artificial Sequence
  Synthetic
aggagaacgcaugauagcg

SEQ ID NO: 5883 - RNA, 19 nt, Artificial Sequence
  Synthetic
cagugaugucuucccuguc

SEQ ID NO: 5884 - RNA, 19 nt, Artificial Sequence
  Synthetic
caccacuagccaguaugau

SEQ ID NO: 5885 - RNA, 19 nt, Artificial Sequence
  Synthetic
ugucuucccugucaccagc

SEQ ID NO: 5886 - RNA, 19 nt, Artificial Sequence
  Synthetic
gaacaucccgagcuaggau

SEQ ID NO: 5887 - RNA, 19 nt, Artificial Sequence
  Synthetic
guucccacucauacaggac

SEQ ID NO: 5888 - RNA, 19 nt, Artificial Sequence
  Synthetic
ccuacccauacauauccca

SEQ ID NO: 5889 - RNA, 19 nt, Artificial Sequence
  Synthetic
caccaauaucaaguccaag

SEQ ID NO: 5890 - RNA, 19 nt, Artificial Sequence
  Synthetic
augauuugcgggacaaagg

SEQ ID NO: 5891 - RNA, 19 nt, Artificial Sequence
  Synthetic
cagacagauagcaccuuca

SEQ ID NO: 5892 - RNA, 19 nt, Artificial Sequence
  Synthetic
acuuguucuugagugaagg

SEQ ID NO: 5893 - RNA, 19 nt, Artificial Sequence
  Synthetic
gagucccaaggagaccuuc

SEQ ID NO: 5894 - RNA, 19 nt, Artificial Sequence
  Synthetic
ucaacugaaagccguuucu

SEQ ID NO: 5895 - RNA, 19 nt, Artificial Sequence
  Synthetic
uggacguacggcgcugggu

SEQ ID NO: 5896 - RNA, 19 nt, Artificial Sequence
  Synthetic
gaugaugggaaagguuaug

SEQ ID NO: 5897 - RNA, 19 nt, Artificial Sequence
  Synthetic
gggcuccgguacaaccuuc

SEQ ID NO: 5898 - RNA, 19 nt, Artificial Sequence
  Synthetic
ggugcaugauuugcgggac

SEQ ID NO: 5899 - RNA, 19 nt, Artificial Sequence
  Synthetic
agccaguaugaugagcuug

SEQ ID NO: 5900 - RNA, 19 nt, Artificial Sequence
  Synthetic
cacccauggacguacggcg

SEQ ID NO: 5901 - RNA, 19 nt, Artificial Sequence
  Synthetic
ccuagagugaaguaacucu

SEQ ID NO: 5902 - RNA, 19 nt, Artificial Sequence
  Synthetic
uuccauggccauguccaac

SEQ ID NO: 5903 - RNA, 19 nt, Artificial Sequence
  Synthetic
cagucugucguaauagcca

SEQ ID NO: 5904 - RNA, 19 nt, Artificial Sequence
  Synthetic
guacccucugagcucgagu

SEQ ID NO: 5905 - RNA, 19 nt, Artificial Sequence
  Synthetic
augagcagcaucaaacugu

SEQ ID NO: 5906 - RNA, 19 nt, Artificial Sequence
  Synthetic
ugcagccuuauuaaccacc

SEQ ID NO: 5907 - RNA, 19 nt, Artificial Sequence
  Synthetic
caugauuugcgggacaaag

SEQ ID NO: 5908 - RNA, 19 nt, Artificial Sequence
  Synthetic
caaacaauggaaugguauu

SEQ ID NO: 5909 - RNA, 19 nt, Artificial Sequence
  Synthetic
ucagggauugcacgugugg

SEQ ID NO: 5910 - RNA, 19 nt, Artificial Sequence
  Synthetic
cccaaggcauccuggccau

SEQ ID NO: 5911 - RNA, 19 nt, Artificial Sequence
  Synthetic
cguacggcgcuggguaucc

SEQ ID NO: 5912 - RNA, 19 nt, Artificial Sequence
  Synthetic
gcuaggaucauccuggcga

SEQ ID NO: 5913 - RNA, 19 nt, Artificial Sequence
  Synthetic
uuagaaagcugauggacca

SEQ ID NO: 5914 - RNA, 19 nt, Artificial Sequence
  Synthetic
uuacccuacccauacauau

SEQ ID NO: 5915 - RNA, 19 nt, Artificial Sequence
  Synthetic
aggcgaacugcauucuggg

SEQ ID NO: 5916 - RNA, 19 nt, Artificial Sequence
  Synthetic
uccaccagcuucuacaaua

SEQ ID NO: 5917 - RNA, 19 nt, Artificial Sequence
  Synthetic
ugauuuacccuacccauac

SEQ ID NO: 5918 - RNA, 19 nt, Artificial Sequence
  Synthetic
caauaucaaguccaagauc

SEQ ID NO: 5919 - RNA, 19 nt, Artificial Sequence
  Synthetic
guucagggauugcacgugu

SEQ ID NO: 5920 - RNA, 19 nt, Artificial Sequence
  Synthetic
cccauggacguacggcgcu

SEQ ID NO: 5921 - RNA, 19 nt, Artificial Sequence
  Synthetic
ugugaagggcuccgguaca

SEQ ID NO: 5922 - RNA, 19 nt, Artificial Sequence
  Synthetic
gaucuggcagcccaucaac

SEQ ID NO: 5923 - RNA, 19 nt, Artificial Sequence
  Synthetic
ccagugggauggugggugu

SEQ ID NO: 5924 - RNA, 19 nt, Artificial Sequence
  Synthetic
uugaaggcagucugucgua

SEQ ID NO: 5925 - RNA, 19 nt, Artificial Sequence
  Synthetic
uccugaugugcacgaacaa

SEQ ID NO: 5926 - RNA, 19 nt, Artificial Sequence
  Synthetic
cgcaaaggugcaugauuug

SEQ ID NO: 5927 - RNA, 19 nt, Artificial Sequence
  Synthetic
ggcaggaaugccuccagac

SEQ ID NO: 5928 - RNA, 19 nt, Artificial Sequence
  Synthetic
caacugguaguccauagug

SEQ ID NO: 5929 - RNA, 19 nt, Artificial Sequence
  Synthetic
cugaggagaacgcaugaua

SEQ ID NO: 5930 - RNA, 19 nt, Artificial Sequence
  Synthetic
uacaacgagcuguuucuac

SEQ ID NO: 5931 - RNA, 19 nt, Artificial Sequence
  Synthetic
aguaacucugucagaggag

SEQ ID NO: 5932 - RNA, 19 nt, Artificial Sequence
  Synthetic
agcuuccuuguccugagca

SEQ ID NO: 5933 - RNA, 19 nt, Artificial Sequence
  Synthetic
ccucuauaccacccacuug

SEQ ID NO: 5934 - RNA, 19 nt, Artificial Sequence
  Synthetic
gcagccuuauuaaccacca

SEQ ID NO: 5935 - RNA, 19 nt, Artificial Sequence
  Synthetic
uggaucugucaggugaagu

SEQ ID NO: 5936 - RNA, 19 nt, Artificial Sequence
  Synthetic
guaguccauagugaaggcg

SEQ ID NO: 5937 - RNA, 19 nt, Artificial Sequence
  Synthetic
accaucugaggagaacgca

SEQ ID NO: 5938 - RNA, 19 nt, Artificial Sequence
  Synthetic
ugaagggcuccgguacaac

SEQ ID NO: 5939 - RNA, 19 nt, Artificial Sequence
  Synthetic
ucucugcuucuuggugucg

SEQ ID NO: 5940 - RNA, 19 nt, Artificial Sequence
  Synthetic
acacagaauccacugguga

SEQ ID NO: 5941 - RNA, 19 nt, Artificial Sequence
  Synthetic
ugaugucuucccugucacc

SEQ ID NO: 5942 - RNA, 19 nt, Artificial Sequence
  Synthetic
uagccggcuuauuacuaga

SEQ ID NO: 5943 - RNA, 19 nt, Artificial Sequence
  Synthetic
cugcagccuuauuaaccac

SEQ ID NO: 5944 - RNA, 19 nt, Artificial Sequence
  Synthetic
agcagacaccaucugagga

SEQ ID NO: 5945 - RNA, 19 nt, Artificial Sequence
  Synthetic
gucauugcauacuguccau

SEQ ID NO: 5946 - RNA, 19 nt, Artificial Sequence
  Synthetic
auggcacccugcucacgca

SEQ ID NO: 5947 - RNA, 19 nt, Artificial Sequence
  Synthetic
acaccuucauuccuagagu

SEQ ID NO: 5948 - RNA, 19 nt, Artificial Sequence
  Synthetic
caugcccucaucuaauguc

SEQ ID NO: 5949 - RNA, 19 nt, Artificial Sequence
  Synthetic
augucuucccugucaccag

SEQ ID NO: 5950 - RNA, 19 nt, Artificial Sequence
  Synthetic
agggcaagauuucgaauca

SEQ ID NO: 5951 - RNA, 19 nt, Artificial Sequence
  Synthetic
ggaugguggguguaagagc

SEQ ID NO: 5952 - RNA, 19 nt, Artificial Sequence
  Synthetic
ugucaccagcccgaaggac

SEQ ID NO: 5953 - RNA, 19 nt, Artificial Sequence
  Synthetic
cccgaaggacaguacgcac

SEQ ID NO: 5954 - RNA, 19 nt, Artificial Sequence
  Synthetic
aacuggauagucagcacca

SEQ ID NO: 5955 - RNA, 19 nt, Artificial Sequence
  Synthetic
cucccucagcuucaauagc

SEQ ID NO: 5956 - RNA, 19 nt, Artificial Sequence
  Synthetic
gagcuugcuuucuugguug

SEQ ID NO: 5957 - RNA, 19 nt, Artificial Sequence
  Synthetic
gagaauaaagcagcugcac

SEQ ID NO: 5958 - RNA, 19 nt, Artificial Sequence
  Synthetic
uacuagagcagacagauag

SEQ ID NO: 5959 - RNA, 19 nt, Artificial Sequence
  Synthetic
cuuccaucccuuccuguuu

SEQ ID NO: 5960 - RNA, 19 nt, Artificial Sequence
  Synthetic
ggguccaccacuagccagu

SEQ ID NO: 5961 - RNA, 19 nt, Artificial Sequence
  Synthetic
cugagcaaguucacagagg

SEQ ID NO: 5962 - RNA, 19 nt, Artificial Sequence
  Synthetic
acaacgagcuguuucuaca

SEQ ID NO: 5963 - RNA, 19 nt, Artificial Sequence
  Synthetic
guugacuuggaucugucag

SEQ ID NO: 5964 - RNA, 19 nt, Artificial Sequence
  Synthetic
gguauccacauccucuucc

SEQ ID NO: 5965 - RNA, 19 nt, Artificial Sequence
  Synthetic
uuucagcaucugugauggu

SEQ ID NO: 5966 - RNA, 19 nt, Artificial Sequence
  Synthetic
cccacccauggacguacgg

SEQ ID NO: 5967 - RNA, 19 nt, Artificial Sequence
  Synthetic
cugcacaaacaauggaaug

SEQ ID NO: 5968 - RNA, 19 nt, Artificial Sequence
  Synthetic
ugauugcugucaccuggag

SEQ ID NO: 5969 - RNA, 19 nt, Artificial Sequence
  Synthetic
gcuuaaccacaacugguag

SEQ ID NO: 5970 - RNA, 19 nt, Artificial Sequence
  Synthetic
uguaagagcuuaaccacaa

SEQ ID NO: 5971 - RNA, 19 nt, Artificial Sequence
  Synthetic
aauagccggcuuauuacua

SEQ ID NO: 5972 - RNA, 19 nt, Artificial Sequence
  Synthetic
guucuugagugaaggacug

SEQ ID NO: 5973 - RNA, 19 nt, Artificial Sequence
  Synthetic
caacuccaucaaaucagcu

SEQ ID NO: 5974 - RNA, 19 nt, Artificial Sequence
  Synthetic
aagagucccaaggagaccu

SEQ ID NO: 5975 - RNA, 19 nt, Artificial Sequence
  Synthetic
acaacugguaguccauagu

SEQ ID NO: 5976 - RNA, 19 nt, Artificial Sequence
  Synthetic
ccuccacaaauugcugcug

SEQ ID NO: 5977 - RNA, 19 nt, Artificial Sequence
  Synthetic
ggguauccugaugugcacg

SEQ ID NO: 5978 - RNA, 19 nt, Artificial Sequence
  Synthetic
acaccaucugaggagaacg

SEQ ID NO: 5979 - RNA, 19 nt, Artificial Sequence
  Synthetic
cucgagucauugcauacug

SEQ ID NO: 5980 - RNA, 19 nt, Artificial Sequence
  Synthetic
gcacaagagccucuauacc

SEQ ID NO: 5981 - RNA, 19 nt, Artificial Sequence
  Synthetic
ggcagcccaucaacuggau

SEQ ID NO: 5982 - RNA, 19 nt, Artificial Sequence
  Synthetic
cuauaccacccacuuggca

SEQ ID NO: 5983 - RNA, 19 nt, Artificial Sequence
  Synthetic
gcgcuggguauccugaugu

SEQ ID NO: 5984 - RNA, 19 nt, Artificial Sequence
  Synthetic
cuccagacuuaaagauggc

SEQ ID NO: 5985 - RNA, 19 nt, Artificial Sequence
  Synthetic
cacgaugaugggaaagguu

SEQ ID NO: 5986 - RNA, 19 nt, Artificial Sequence
  Synthetic
gaacaagcaacugaacuag

SEQ ID NO: 5987 - RNA, 19 nt, Artificial Sequence
  Synthetic
cuacuuguucuugagugaa

SEQ ID NO: 5988 - RNA, 19 nt, Artificial Sequence
  Synthetic
ugggccaucucugcuucuu

SEQ ID NO: 5989 - RNA, 19 nt, Artificial Sequence
  Synthetic
aaguaacucugucagagga

SEQ ID NO: 5990 - RNA, 19 nt, Artificial Sequence
  Synthetic
uaguccucugauaacaauu

SEQ ID NO: 5991 - RNA, 19 nt, Artificial Sequence
  Synthetic
cuugagugaaggacugaga

SEQ ID NO: 5992 - RNA, 19 nt, Artificial Sequence
  Synthetic
gcaugauagcgugucugga

SEQ ID NO: 5993 - RNA, 19 nt, Artificial Sequence
  Synthetic
caaacgcuggacauuagug

SEQ ID NO: 5994 - RNA, 19 nt, Artificial Sequence
  Synthetic
guaucacagcagguuacaa

SEQ ID NO: 5995 - RNA, 19 nt, Artificial Sequence
  Synthetic
uaucaucugaacccagaag

SEQ ID NO: 5996 - RNA, 19 nt, Artificial Sequence
  Synthetic
ccacccauggacguacggc

SEQ ID NO: 5997 - RNA, 19 nt, Artificial Sequence
  Synthetic
ccgguacaaccuucaacua

SEQ ID NO: 5998 - RNA, 19 nt, Artificial Sequence
  Synthetic
aaucuuguggcuuguccuc

SEQ ID NO: 5999 - RNA, 19 nt, Artificial Sequence
  Synthetic
cagaggagcuguggcuccc

SEQ ID NO: 6000 - RNA, 19 nt, Artificial Sequence
  Synthetic
uuggaucugucaggugaag

SEQ ID NO: 6001 - RNA, 19 nt, Artificial Sequence
  Synthetic
aguugcagcaucugaaaga

SEQ ID NO: 6002 - RNA, 19 nt, Artificial Sequence
  Synthetic
cguaucacagcagguuaca

SEQ ID NO: 6003 - RNA, 19 nt, Artificial Sequence
  Synthetic
ucauacaggacuugggagg

SEQ ID NO: 6004 - RNA, 19 nt, Artificial Sequence
  Synthetic
accagcuaaacgcacugcc

SEQ ID NO: 6005 - RNA, 19 nt, Artificial Sequence
  Synthetic
agccggcuuauuacuagag

SEQ ID NO: 6006 - RNA, 19 nt, Artificial Sequence
  Synthetic
gcugccagugacuaacagc

SEQ ID NO: 6007 - RNA, 19 nt, Artificial Sequence
  Synthetic
uucugaacaagacguugac

SEQ ID NO: 6008 - RNA, 19 nt, Artificial Sequence
  Synthetic
agguauccacauccucuuc

SEQ ID NO: 6009 - RNA, 19 nt, Artificial Sequence
  Synthetic
aucguaucacagcagguua

SEQ ID NO: 6010 - RNA, 19 nt, Artificial Sequence
  Synthetic
aaacaagguuccaaauaac

SEQ ID NO: 6011 - RNA, 19 nt, Artificial Sequence
  Synthetic
gauaacaauucgguuguga

SEQ ID NO: 6012 - RNA, 19 nt, Artificial Sequence
  Synthetic
cuucccugucaccagcccg

SEQ ID NO: 6013 - RNA, 19 nt, Artificial Sequence
  Synthetic
cugauaacaauucgguugu

SEQ ID NO: 6014 - RNA, 19 nt, Artificial Sequence
  Synthetic
aaacgcuggacauuagugg

SEQ ID NO: 6015 - RNA, 19 nt, Artificial Sequence
  Synthetic
acagauggcaggcucagug

SEQ ID NO: 6016 - RNA, 19 nt, Artificial Sequence
  Synthetic
uuuagaaagcugauggacc

SEQ ID NO: 6017 - RNA, 19 nt, Artificial Sequence
  Synthetic
guuacaacaacuuugggau

SEQ ID NO: 6018 - RNA, 19 nt, Artificial Sequence
  Synthetic
ucguaaguauagguccuca

SEQ ID NO: 6019 - RNA, 19 nt, Artificial Sequence
  Synthetic
uguggcuuguccucagaca

SEQ ID NO: 6020 - RNA, 19 nt, Artificial Sequence
  Synthetic
aucuggcagcccaucaacu

SEQ ID NO: 6021 - RNA, 19 nt, Artificial Sequence
  Synthetic
ucuuggugucggcugguca

SEQ ID NO: 6022 - RNA, 19 nt, Artificial Sequence
  Synthetic
agaggagcuguggcucccu

SEQ ID NO: 6023 - RNA, 19 nt, Artificial Sequence
  Synthetic
agcagguuacaacaacuuu

SEQ ID NO: 6024 - RNA, 19 nt, Artificial Sequence
  Synthetic
ugauggaccauaacugcag

SEQ ID NO: 6025 - RNA, 19 nt, Artificial Sequence
  Synthetic
ggcuccgguacaaccuuca

SEQ ID NO: 6026 - RNA, 19 nt, Artificial Sequence
  Synthetic
caucuaaugucucagggaa

SEQ ID NO: 6027 - RNA, 19 nt, Artificial Sequence
  Synthetic
cccugucaccagcccgaag

SEQ ID NO: 6028 - RNA, 19 nt, Artificial Sequence
  Synthetic
agagagcuggucagcucaa

SEQ ID NO: 6029 - RNA, 19 nt, Artificial Sequence
  Synthetic
ccuuguccugagcaaguuc

SEQ ID NO: 6030 - RNA, 19 nt, Artificial Sequence
  Synthetic
gcuucuuggugucggcugg

SEQ ID NO: 6031 - RNA, 19 nt, Artificial Sequence
  Synthetic
agucguggaauggcacccu

SEQ ID NO: 6032 - RNA, 19 nt, Artificial Sequence
  Synthetic
gaauaaagcagcugcacaa

SEQ ID NO: 6033 - RNA, 19 nt, Artificial Sequence
  Synthetic
gcuacuuguucuugaguga

SEQ ID NO: 6034 - RNA, 19 nt, Artificial Sequence
  Synthetic
aagcuugcauuccaccagc

SEQ ID NO: 6035 - RNA, 19 nt, Artificial Sequence
  Synthetic
ucccuuccuguuuaguugc

SEQ ID NO: 6036 - RNA, 19 nt, Artificial Sequence
  Synthetic
aagggcuccgguacaaccu

SEQ ID NO: 6037 - RNA, 19 nt, Artificial Sequence
  Synthetic
uggaccauaacugcagccu

SEQ ID NO: 6038 - RNA, 19 nt, Artificial Sequence
  Synthetic
cuguguagaugggaucugc

SEQ ID NO: 6039 - RNA, 19 nt, Artificial Sequence
  Synthetic
gccacaccuucauuccuag

SEQ ID NO: 6040 - RNA, 19 nt, Artificial Sequence
  Synthetic
accacucagagaaggagcu

SEQ ID NO: 6041 - RNA, 19 nt, Artificial Sequence
  Synthetic
agguuguggagaguuguaa

SEQ ID NO: 6042 - RNA, 19 nt, Artificial Sequence
  Synthetic
ccucaggauugccuuuacc

SEQ ID NO: 6043 - RNA, 19 nt, Artificial Sequence
  Synthetic
guccauagugaaggcgaac

SEQ ID NO: 6044 - RNA, 19 nt, Artificial Sequence
  Synthetic
gccaagaauuuaacauuug

SEQ ID NO: 6045 - RNA, 19 nt, Artificial Sequence
  Synthetic
uugaagcaucguaucacag

SEQ ID NO: 6046 - RNA, 19 nt, Artificial Sequence
  Synthetic
cuguuucuacaucauuugu

SEQ ID NO: 6047 - RNA, 19 nt, Artificial Sequence
  Synthetic
gaacauagcagcucguacc

SEQ ID NO: 6048 - RNA, 19 nt, Artificial Sequence
  Synthetic
aguccucugauaacaauuc

SEQ ID NO: 6049 - RNA, 19 nt, Artificial Sequence
  Synthetic
ucugauaacaauucgguug

SEQ ID NO: 6050 - RNA, 19 nt, Artificial Sequence
  Synthetic
ucuugaagcaucguaucac

SEQ ID NO: 6051 - RNA, 19 nt, Artificial Sequence
  Synthetic
cuuccucaggauugccuuu

SEQ ID NO: 6052 - RNA, 19 nt, Artificial Sequence
  Synthetic
aacucugucagaggagcug

SEQ ID NO: 6053 - RNA, 19 nt, Artificial Sequence
  Synthetic
cacccacuuggcagaccau

SEQ ID NO: 6054 - RNA, 19 nt, Artificial Sequence
  Synthetic
gaaucaauccaacaguagc

SEQ ID NO: 6055 - RNA, 19 nt, Artificial Sequence
  Synthetic
cugagcucgagucauugca

SEQ ID NO: 6056 - RNA, 19 nt, Artificial Sequence
  Synthetic
ugggcaccaauaucaaguc

SEQ ID NO: 6057 - RNA, 19 nt, Artificial Sequence
  Synthetic
gaguccaaagacaguucug

SEQ ID NO: 6058 - RNA, 19 nt, Artificial Sequence
  Synthetic
cgaacaagcaacugaacua

SEQ ID NO: 6059 - RNA, 19 nt, Artificial Sequence
  Synthetic
aaauuugaaggcagucugu

SEQ ID NO: 6060 - RNA, 19 nt, Artificial Sequence
  Synthetic
aagagccucuauaccaccc

SEQ ID NO: 6061 - RNA, 19 nt, Artificial Sequence
  Synthetic
accacaacugguaguccau

SEQ ID NO: 6062 - RNA, 19 nt, Artificial Sequence
  Synthetic
uuaguccucugauaacaau

SEQ ID NO: 6063 - RNA, 19 nt, Artificial Sequence
  Synthetic
gaccauaacugcagccuua

SEQ ID NO: 6064 - RNA, 19 nt, Artificial Sequence
  Synthetic
gggacaaagggcaagauuu

SEQ ID NO: 6065 - RNA, 19 nt, Artificial Sequence
  Synthetic
cccuccacaaauugcugcu

SEQ ID NO: 6066 - RNA, 19 nt, Artificial Sequence
  Synthetic
gaaugguauuuaguccucu

SEQ ID NO: 6067 - RNA, 19 nt, Artificial Sequence
  Synthetic
gacagauagcaccuucagc

SEQ ID NO: 6068 - RNA, 19 nt, Artificial Sequence
  Synthetic
cccuguucccacucauaca

SEQ ID NO: 6069 - RNA, 19 nt, Artificial Sequence
  Synthetic
acuguguagaugggaucug

SEQ ID NO: 6070 - RNA, 19 nt, Artificial Sequence
  Synthetic
cacaaauugcugcuguguc

SEQ ID NO: 6071 - RNA, 19 nt, Artificial Sequence
  Synthetic
agaugggaucugcaugccc

SEQ ID NO: 6072 - RNA, 19 nt, Artificial Sequence
  Synthetic
ccaugagguccugggcaug

SEQ ID NO: 6073 - RNA, 19 nt, Artificial Sequence
  Synthetic
cuguggcucccucagcuuc

SEQ ID NO: 6074 - RNA, 19 nt, Artificial Sequence
  Synthetic
ugcugccagugacuaacag

SEQ ID NO: 6075 - RNA, 19 nt, Artificial Sequence
  Synthetic
aacccagaagcugaacaag

SEQ ID NO: 6076 - RNA, 19 nt, Artificial Sequence
  Synthetic
gcuugcauuccaccagcuu

SEQ ID NO: 6077 - RNA, 19 nt, Artificial Sequence
  Synthetic
gggagguauccacauccuc

SEQ ID NO: 6078 - RNA, 19 nt, Artificial Sequence
  Synthetic
cacaggugaccacauuuau

SEQ ID NO: 6079 - RNA, 19 nt, Artificial Sequence
  Synthetic
ugucccacccauggacgua

SEQ ID NO: 6080 - RNA, 19 nt, Artificial Sequence
  Synthetic
ggccauguccaacuccauc

SEQ ID NO: 6081 - RNA, 19 nt, Artificial Sequence
  Synthetic
uucagccaaacgcuggaca

SEQ ID NO: 6082 - RNA, 19 nt, Artificial Sequence
  Synthetic
guggaauggcacccugcuc

SEQ ID NO: 6083 - RNA, 19 nt, Artificial Sequence
  Synthetic
auagguccucauuauauuu

SEQ ID NO: 6084 - RNA, 19 nt, Artificial Sequence
  Synthetic
gguccaccacuagccagua

SEQ ID NO: 6085 - RNA, 19 nt, Artificial Sequence
  Synthetic
uccacuggugaaccaagca

SEQ ID NO: 6086 - RNA, 19 nt, Artificial Sequence
  Synthetic
ucuuguggcuuguccucag

SEQ ID NO: 6087 - RNA, 19 nt, Artificial Sequence
  Synthetic
gaaggacaguacgcacaag

SEQ ID NO: 6088 - RNA, 19 nt, Artificial Sequence
  Synthetic
aacaagguuccaaauaaca

SEQ ID NO: 6089 - RNA, 19 nt, Artificial Sequence
  Synthetic
ucuugguugccauaagcua

SEQ ID NO: 6090 - RNA, 19 nt, Artificial Sequence
  Synthetic
cucuugaagcaucguauca

SEQ ID NO: 6091 - RNA, 19 nt, Artificial Sequence
  Synthetic
cacaagagccucuauacca

SEQ ID NO: 6092 - RNA, 19 nt, Artificial Sequence
  Synthetic
aacgagcuguuucuacauc

SEQ ID NO: 6093 - RNA, 19 nt, Artificial Sequence
  Synthetic
cucacgaugaugggaaagg

SEQ ID NO: 6094 - RNA, 19 nt, Artificial Sequence
  Synthetic
caccaucugaggagaacgc

SEQ ID NO: 6095 - RNA, 19 nt, Artificial Sequence
  Synthetic
acggcgcuggguauccuga

SEQ ID NO: 6096 - RNA, 19 nt, Artificial Sequence
  Synthetic
cagcucaacugaaagccgu

SEQ ID NO: 6097 - RNA, 19 nt, Artificial Sequence
  Synthetic
cuccgguacaaccuucaac

SEQ ID NO: 6098 - RNA, 19 nt, Artificial Sequence
  Synthetic
uaggaucauccuggcgaua

SEQ ID NO: 6099 - RNA, 19 nt, Artificial Sequence
  Synthetic
cagauagcaccuucagcac

SEQ ID NO: 6100 - RNA, 19 nt, Artificial Sequence
  Synthetic
uuccugagaguccaaagac

SEQ ID NO: 6101 - RNA, 19 nt, Artificial Sequence
  Synthetic
caaggagaccuuccauccc

SEQ ID NO: 6102 - RNA, 19 nt, Artificial Sequence
  Synthetic
gagagagcuggucagcuca

SEQ ID NO: 6103 - RNA, 19 nt, Artificial Sequence
  Synthetic
ccucacgaugaugggaaag

SEQ ID NO: 6104 - RNA, 19 nt, Artificial Sequence
  Synthetic
aggugaaguccuaaagcuu

SEQ ID NO: 6105 - RNA, 19 nt, Artificial Sequence
  Synthetic
uccuaaagcuugcauucca

SEQ ID NO: 6106 - RNA, 19 nt, Artificial Sequence
  Synthetic
agggcaggaaugccuccag

SEQ ID NO: 6107 - RNA, 19 nt, Artificial Sequence
  Synthetic
acgaacaagcaacugaacu

SEQ ID NO: 6108 - RNA, 19 nt, Artificial Sequence
  Synthetic
ucagggaacauagcagcuc

SEQ ID NO: 6109 - RNA, 19 nt, Artificial Sequence
  Synthetic
uacccaaggcauccuggcc

SEQ ID NO: 6110 - RNA, 19 nt, Artificial Sequence
  Synthetic
aacgauagcuaggaucauc

SEQ ID NO: 6111 - RNA, 19 nt, Artificial Sequence
  Synthetic
gcaagauuucgaaucaauc

SEQ ID NO: 6112 - RNA, 19 nt, Artificial Sequence
  Synthetic
gcauucugggccaucucug

SEQ ID NO: 6113 - RNA, 19 nt, Artificial Sequence
  Synthetic
ccauggacguacggcgcug

SEQ ID NO: 6114 - RNA, 19 nt, Artificial Sequence
  Synthetic
caacgagcuguuucuacau

SEQ ID NO: 6115 - RNA, 19 nt, Artificial Sequence
  Synthetic
agauagcaccuucagcacu

SEQ ID NO: 6116 - RNA, 19 nt, Artificial Sequence
  Synthetic
uuaaccacaacugguaguc

SEQ ID NO: 6117 - RNA, 19 nt, Artificial Sequence
  Synthetic
accuuccaucccuuccugu

SEQ ID NO: 6118 - RNA, 19 nt, Artificial Sequence
  Synthetic
ccuuauuaaccaccaccug

SEQ ID NO: 6119 - RNA, 19 nt, Artificial Sequence
  Synthetic
ggaccauaacugcagccuu

SEQ ID NO: 6120 - RNA, 19 nt, Artificial Sequence
  Synthetic
gcacaggugaccacauuua

SEQ ID NO: 6121 - RNA, 19 nt, Artificial Sequence
  Synthetic
aauccaacaguagccuuua

SEQ ID NO: 6122 - RNA, 19 nt, Artificial Sequence
  Synthetic
ucauugcauacuguccauc

SEQ ID NO: 6123 - RNA, 19 nt, Artificial Sequence
  Synthetic
auaucaucugaacccagaa

SEQ ID NO: 6124 - RNA, 19 nt, Artificial Sequence
  Synthetic
ccagcccgaaggacaguac

SEQ ID NO: 6125 - RNA, 19 nt, Artificial Sequence
  Synthetic
aauccacuggugaaccaag

SEQ ID NO: 6126 - RNA, 19 nt, Artificial Sequence
  Synthetic
ggcucccucagcuucaaua

SEQ ID NO: 6127 - RNA, 19 nt, Artificial Sequence
  Synthetic
cacagcagguuacaacaac

SEQ ID NO: 6128 - RNA, 19 nt, Artificial Sequence
  Synthetic
cguggaauggcacccugcu

SEQ ID NO: 6129 - RNA, 19 nt, Artificial Sequence
  Synthetic
gagcaaguucacagaggac

SEQ ID NO: 6130 - RNA, 19 nt, Artificial Sequence
  Synthetic
uuggugucggcuggucaga

SEQ ID NO: 6131 - RNA, 19 nt, Artificial Sequence
  Synthetic
uucugucugguuccauggc

SEQ ID NO: 6132 - RNA, 19 nt, Artificial Sequence
  Synthetic
cccucagcuucaauagcuu

SEQ ID NO: 6133 - RNA, 19 nt, Artificial Sequence
  Synthetic
aagggcaagauuucgaauc

SEQ ID NO: 6134 - RNA, 19 nt, Artificial Sequence
  Synthetic
ugugcacgaacaagcaacu

SEQ ID NO: 6135 - RNA, 19 nt, Artificial Sequence
  Synthetic
agaccaucaucuuguucuu

SEQ ID NO: 6136 - RNA, 19 nt, Artificial Sequence
  Synthetic
caggauugccuuuaccacu

SEQ ID NO: 6137 - RNA, 19 nt, Artificial Sequence
  Synthetic
uguuuaguugcagcaucug

SEQ ID NO: 6138 - RNA, 19 nt, Artificial Sequence
  Synthetic
ccucaucuaaugucucagg

SEQ ID NO: 6139 - RNA, 19 nt, Artificial Sequence
  Synthetic
gguuacaacaacuuuggga

SEQ ID NO: 6140 - RNA, 19 nt, Artificial Sequence
  Synthetic
cuuggugucggcuggucag

SEQ ID NO: 6141 - RNA, 19 nt, Artificial Sequence
  Synthetic
cugcagcuacucuuuggau

SEQ ID NO: 6142 - RNA, 19 nt, Artificial Sequence
  Synthetic
ucagccaaacgcuggacau

SEQ ID NO: 6143 - RNA, 19 nt, Artificial Sequence
  Synthetic
aaggacaguacgcacaaga

SEQ ID NO: 6144 - RNA, 19 nt, Artificial Sequence
  Synthetic
ugggagguauccacauccu

SEQ ID NO: 6145 - RNA, 19 nt, Artificial Sequence
  Synthetic
auggaccauaacugcagcc

SEQ ID NO: 6146 - RNA, 19 nt, Artificial Sequence
  Synthetic
aucccgagcuaggauguga

SEQ ID NO: 6147 - RNA, 19 nt, Artificial Sequence
  Synthetic
gccaucucugcuucuuggu

SEQ ID NO: 6148 - RNA, 19 nt, Artificial Sequence
  Synthetic
ucagcaccagggugguggc

SEQ ID NO: 6149 - RNA, 19 nt, Artificial Sequence
  Synthetic
aacgcuggacauuaguggg

SEQ ID NO: 6150 - RNA, 19 nt, Artificial Sequence
  Synthetic
uaagacuguugcugccagu

SEQ ID NO: 6151 - RNA, 19 nt, Artificial Sequence
  Synthetic
uguuacacuuuauucagau

SEQ ID NO: 6152 - RNA, 19 nt, Artificial Sequence
  Synthetic
aagagcacagauggcaggc

SEQ ID NO: 6153 - RNA, 19 nt, Artificial Sequence
  Synthetic
guuguggagaguuguaaug

SEQ ID NO: 6154 - RNA, 19 nt, Artificial Sequence
  Synthetic
gcagacaccaucugaggag

SEQ ID NO: 6155 - RNA, 19 nt, Artificial Sequence
  Synthetic
gugcacgaacaagcaacug

SEQ ID NO: 6156 - RNA, 19 nt, Artificial Sequence
  Synthetic
acauccucuuccucaggau

SEQ ID NO: 6157 - RNA, 19 nt, Artificial Sequence
  Synthetic
aacacagaauccacuggug

SEQ ID NO: 6158 - RNA, 19 nt, Artificial Sequence
  Synthetic
ugaugagcuugcuuucuug

SEQ ID NO: 6159 - RNA, 19 nt, Artificial Sequence
  Synthetic
augggaaagguuaugcaag

SEQ ID NO: 6160 - RNA, 19 nt, Artificial Sequence
  Synthetic
cugguaguccauagugaag

SEQ ID NO: 6161 - RNA, 19 nt, Artificial Sequence
  Synthetic
gaugugcacgaacaagcaa

SEQ ID NO: 6162 - RNA, 19 nt, Artificial Sequence
  Synthetic
cugcaugguacguacaaua

SEQ ID NO: 6163 - RNA, 19 nt, Artificial Sequence
  Synthetic
ggacaaagggcaagauuuc

SEQ ID NO: 6164 - RNA, 19 nt, Artificial Sequence
  Synthetic
aggacaguacgcacaagag

SEQ ID NO: 6165 - RNA, 19 nt, Artificial Sequence
  Synthetic
ugauaacaauucgguugug

SEQ ID NO: 6166 - RNA, 19 nt, Artificial Sequence
  Synthetic
guaacucugucagaggagc

SEQ ID NO: 6167 - RNA, 19 nt, Artificial Sequence
  Synthetic
gaugguucagccaaacgcu

SEQ ID NO: 6168 - RNA, 19 nt, Artificial Sequence
  Synthetic
gcucaacugaaagccguuu

SEQ ID NO: 6169 - RNA, 19 nt, Artificial Sequence
  Synthetic
gcaugauuugcgggacaaa

SEQ ID NO: 6170 - RNA, 19 nt, Artificial Sequence
  Synthetic
ccacaccuucauuccuaga

SEQ ID NO: 6171 - RNA, 19 nt, Artificial Sequence
  Synthetic
ucccacucauacaggacuu

SEQ ID NO: 6172 - RNA, 19 nt, Artificial Sequence
  Synthetic
cagaauccacuggugaacc

SEQ ID NO: 6173 - RNA, 19 nt, Artificial Sequence
  Synthetic
accacccacuuggcagacc

SEQ ID NO: 6174 - RNA, 19 nt, Artificial Sequence
  Synthetic
uaacucugucagaggagcu

SEQ ID NO: 6175 - RNA, 19 nt, Artificial Sequence
  Synthetic
ugugguaguggcaccagaa

SEQ ID NO: 6176 - RNA, 19 nt, Artificial Sequence
  Synthetic
ugucucagggaacauagca

SEQ ID NO: 6177 - RNA, 19 nt, Artificial Sequence
  Synthetic
ggcaagauuucgaaucaau

SEQ ID NO: 6178 - RNA, 19 nt, Artificial Sequence
  Synthetic
gaggcagcccauccaugag

SEQ ID NO: 6179 - RNA, 19 nt, Artificial Sequence
  Synthetic
aaugggagaauaaagcagc

SEQ ID NO: 6180 - RNA, 19 nt, Artificial Sequence
  Synthetic
ucacgcaaaggugcaugau

SEQ ID NO: 6181 - RNA, 19 nt, Artificial Sequence
  Synthetic
gacuguugcugccagugac

SEQ ID NO: 6182 - RNA, 19 nt, Artificial Sequence
  Synthetic
aaaucccuguucccacuca

SEQ ID NO: 6183 - RNA, 19 nt, Artificial Sequence
  Synthetic
ucaucuuguucuuauaauu

SEQ ID NO: 6184 - RNA, 19 nt, Artificial Sequence
  Synthetic
gcaacugguaaacugucca

SEQ ID NO: 6185 - RNA, 19 nt, Artificial Sequence
  Synthetic
cguaaguauagguccucau

SEQ ID NO: 6186 - RNA, 19 nt, Artificial Sequence
  Synthetic
agucccaaggagaccuucc

SEQ ID NO: 6187 - RNA, 19 nt, Artificial Sequence
  Synthetic
ccuucaacuauuucuucca

SEQ ID NO: 6188 - RNA, 19 nt, Artificial Sequence
  Synthetic
caagguuccaaauaacacc

SEQ ID NO: 6189 - RNA, 19 nt, Artificial Sequence
  Synthetic
gucagaugacgaagagcac

SEQ ID NO: 6190 - RNA, 19 nt, Artificial Sequence
  Synthetic
ucugucugguuccauggcc

SEQ ID NO: 6191 - RNA, 19 nt, Artificial Sequence
  Synthetic
ugccagugacuaacagccg

SEQ ID NO: 6192 - RNA, 19 nt, Artificial Sequence
  Synthetic
aacugaacuagucguggaa

SEQ ID NO: 6193 - RNA, 19 nt, Artificial Sequence
  Synthetic
auucugggccaucucugcu

SEQ ID NO: 6194 - RNA, 19 nt, Artificial Sequence
  Synthetic
uagcuaggaucauccuggc

SEQ ID NO: 6195 - RNA, 19 nt, Artificial Sequence
  Synthetic
gacgaagagcacagauggc

SEQ ID NO: 6196 - RNA, 19 nt, Artificial Sequence
  Synthetic
guacaacgagcuguuucua

SEQ ID NO: 6197 - RNA, 19 nt, Artificial Sequence
  Synthetic
acuuggcagaccaucaucu

SEQ ID NO: 6198 - RNA, 19 nt, Artificial Sequence
  Synthetic
ucacgaugaugggaaaggu

SEQ ID NO: 6199 - RNA, 19 nt, Artificial Sequence
  Synthetic
uggccauguccaacuccau

SEQ ID NO: 6200 - RNA, 19 nt, Artificial Sequence
  Synthetic
cagaugacgaagagcacag

SEQ ID NO: 6201 - RNA, 19 nt, Artificial Sequence
  Synthetic
ccaucaucuuguucuuaua

SEQ ID NO: 6202 - RNA, 19 nt, Artificial Sequence
  Synthetic
uuguuacacuuuauucaga

SEQ ID NO: 6203 - RNA, 19 nt, Artificial Sequence
  Synthetic
aaggcgaacugcauucugg

SEQ ID NO: 6204 - RNA, 19 nt, Artificial Sequence
  Synthetic
cagaccaucaucuuguucu

SEQ ID NO: 6205 - RNA, 19 nt, Artificial Sequence
  Synthetic
gcgggacaaagggcaagau

SEQ ID NO: 6206 - RNA, 19 nt, Artificial Sequence
  Synthetic
cagcccaccagcuaaacgc

SEQ ID NO: 6207 - RNA, 19 nt, Artificial Sequence
  Synthetic
auuuauaucaucugaaccc

SEQ ID NO: 6208 - RNA, 19 nt, Artificial Sequence
  Synthetic
ugucaggugaaguccuaaa

SEQ ID NO: 6209 - RNA, 19 nt, Artificial Sequence
  Synthetic
acucagagaaggagcugug

SEQ ID NO: 6210 - RNA, 19 nt, Artificial Sequence
  Synthetic
caguucugaacaagacguu

SEQ ID NO: 6211 - RNA, 19 nt, Artificial Sequence
  Synthetic
uccacaaauugcugcugug

SEQ ID NO: 6212 - RNA, 19 nt, Artificial Sequence
  Synthetic
acaagcaacugaacuaguc

SEQ ID NO: 6213 - RNA, 19 nt, Artificial Sequence
  Synthetic
aauuugaaggcagucuguc

SEQ ID NO: 6214 - RNA, 19 nt, Artificial Sequence
  Synthetic
cucuguucugaagagagag

SEQ ID NO: 6215 - RNA, 19 nt, Artificial Sequence
  Synthetic
guucagccaaacgcuggac

SEQ ID NO: 6216 - RNA, 19 nt, Artificial Sequence
  Synthetic
gaccaucaucuuguucuua

SEQ ID NO: 6217 - RNA, 19 nt, Artificial Sequence
  Synthetic
aacaagacguugacuugga

SEQ ID NO: 6218 - RNA, 19 nt, Artificial Sequence
  Synthetic
caucucugcuucuuggugu

SEQ ID NO: 6219 - RNA, 19 nt, Artificial Sequence
  Synthetic
caucugaaagauuccugag

SEQ ID NO: 6220 - RNA, 19 nt, Artificial Sequence
  Synthetic
cguaauagccaagaauuua

SEQ ID NO: 6221 - RNA, 19 nt, Artificial Sequence
  Synthetic
cacaacugguaguccauag

SEQ ID NO: 6222 - RNA, 19 nt, Artificial Sequence
  Synthetic
ugguucagccaaacgcugg

SEQ ID NO: 6223 - RNA, 19 nt, Artificial Sequence
  Synthetic
agcccucacgaugauggga

SEQ ID NO: 6224 - RNA, 19 nt, Artificial Sequence
  Synthetic
aucugucaggugaaguccu

SEQ ID NO: 6225 - RNA, 19 nt, Artificial Sequence
  Synthetic
cgaaggacaguacgcacaa

SEQ ID NO: 6226 - RNA, 19 nt, Artificial Sequence
  Synthetic
ugcugugucccacccaugg

SEQ ID NO: 6227 - RNA, 19 nt, Artificial Sequence
  Synthetic
ccaaggagaccuuccaucc

SEQ ID NO: 6228 - RNA, 19 nt, Artificial Sequence
  Synthetic
auggacguacggcgcuggg

SEQ ID NO: 6229 - RNA, 19 nt, Artificial Sequence
  Synthetic
cagcucguacccucugagc

SEQ ID NO: 6230 - RNA, 19 nt, Artificial Sequence
  Synthetic
acaauucgguugugaacau

SEQ ID NO: 6231 - RNA, 19 nt, Artificial Sequence
  Synthetic
ugaugugcacgaacaagca

SEQ ID NO: 6232 - RNA, 19 nt, Artificial Sequence
  Synthetic
cuaaugucucagggaacau

SEQ ID NO: 6233 - RNA, 19 nt, Artificial Sequence
  Synthetic
uccucaggauugccuuuac

SEQ ID NO: 6234 - RNA, 19 nt, Artificial Sequence
  Synthetic
aagacuguugcugccagug

SEQ ID NO: 6235 - RNA, 19 nt, Artificial Sequence
  Synthetic
ucugaggagaacgcaugau

SEQ ID NO: 6236 - RNA, 19 nt, Artificial Sequence
  Synthetic
uuuacccuacccauacaua

SEQ ID NO: 6237 - RNA, 19 nt, Artificial Sequence
  Synthetic
acaagguuccaaauaacac

SEQ ID NO: 6238 - RNA, 19 nt, Artificial Sequence
  Synthetic
acucugucagaggagcugu

SEQ ID NO: 6239 - RNA, 19 nt, Artificial Sequence
  Synthetic
ccacaacugguaguccaua

SEQ ID NO: 6240 - RNA, 19 nt, Artificial Sequence
  Synthetic
gugguaguggcaccagaau

SEQ ID NO: 6241 - RNA, 19 nt, Artificial Sequence
  Synthetic
uugcugucaccuggaggca

SEQ ID NO: 6242 - RNA, 19 nt, Artificial Sequence
  Synthetic
auacaggacuugggaggua

SEQ ID NO: 6243 - RNA, 19 nt, Artificial Sequence
  Synthetic
cgcaugauagcgugucugg

SEQ ID NO: 6244 - RNA, 19 nt, Artificial Sequence
  Synthetic
uguggcaaguucugcauca

SEQ ID NO: 6245 - RNA, 19 nt, Artificial Sequence
  Synthetic
ugcagcccaccagcuaaac

SEQ ID NO: 6246 - RNA, 19 nt, Artificial Sequence
  Synthetic
uaccacccacuuggcagac

SEQ ID NO: 6247 - RNA, 19 nt, Artificial Sequence
  Synthetic
gaagggcuccgguacaacc

SEQ ID NO: 6248 - RNA, 19 nt, Artificial Sequence
  Synthetic
augugaagggcuccgguac

SEQ ID NO: 6249 - RNA, 19 nt, Artificial Sequence
  Synthetic
auccucuuccucaggauug

SEQ ID NO: 6250 - RNA, 19 nt, Artificial Sequence
  Synthetic
acuagagcagacagauagc

SEQ ID NO: 6251 - RNA, 19 nt, Artificial Sequence
  Synthetic
cguugacuuggaucuguca

SEQ ID NO: 6252 - RNA, 19 nt, Artificial Sequence
  Synthetic
caucucauguuccaucaug

SEQ ID NO: 6253 - RNA, 19 nt, Artificial Sequence
  Synthetic
aagauuccugagaguccaa

SEQ ID NO: 6254 - RNA, 19 nt, Artificial Sequence
  Synthetic
cuggucagaugacgaagag

SEQ ID NO: 6255 - RNA, 19 nt, Artificial Sequence
  Synthetic
uuugcgggacaaagggcaa

SEQ ID NO: 6256 - RNA, 19 nt, Artificial Sequence
  Synthetic
ucugggccaucucugcuuc

SEQ ID NO: 6257 - RNA, 19 nt, Artificial Sequence
  Synthetic
ugggaaagguuaugcaagg

SEQ ID NO: 6258 - RNA, 19 nt, Artificial Sequence
  Synthetic
gaugagcagcaucaaacug

SEQ ID NO: 6259 - RNA, 19 nt, Artificial Sequence
  Synthetic
ugacuuggaucugucaggu

SEQ ID NO: 6260 - RNA, 19 nt, Artificial Sequence
  Synthetic
uaguugcagcaucugaaag

SEQ ID NO: 6261 - RNA, 19 nt, Artificial Sequence
  Synthetic
ucucuugaagcaucguauc

SEQ ID NO: 6262 - RNA, 19 nt, Artificial Sequence
  Synthetic
gaaguccuaaagcuugcau

SEQ ID NO: 6263 - RNA, 19 nt, Artificial Sequence
  Synthetic
uugggagguauccacaucc

SEQ ID NO: 6264 - RNA, 19 nt, Artificial Sequence
  Synthetic
ugaaggcgaacugcauucu

SEQ ID NO: 6265 - RNA, 19 nt, Artificial Sequence
  Synthetic
gacaaagggcaagauuucg

SEQ ID NO: 6266 - RNA, 19 nt, Artificial Sequence
  Synthetic
cagcuacuuguucuugagu

SEQ ID NO: 6267 - RNA, 19 nt, Artificial Sequence
  Synthetic
ugucgccacaccuucauuc

SEQ ID NO: 6268 - RNA, 19 nt, Artificial Sequence
  Synthetic
cugcucacgcaaaggugca

SEQ ID NO: 6269 - RNA, 19 nt, Artificial Sequence
  Synthetic
agggaacauagcagcucgu

SEQ ID NO: 6270 - RNA, 19 nt, Artificial Sequence
  Synthetic
gagguauccacauccucuu

SEQ ID NO: 6271 - RNA, 19 nt, Artificial Sequence
  Synthetic
aaggcauccuggccauauc

SEQ ID NO: 6272 - RNA, 19 nt, Artificial Sequence
  Synthetic
acgcacaagagccucuaua

SEQ ID NO: 6273 - RNA, 19 nt, Artificial Sequence
  Synthetic
cauuuauaucaucugaacc

SEQ ID NO: 6274 - RNA, 19 nt, Artificial Sequence
  Synthetic
aaggagaccuuccaucccu

SEQ ID NO: 6275 - RNA, 19 nt, Artificial Sequence
  Synthetic
uuacaacaacuuugggaua

SEQ ID NO: 6276 - RNA, 19 nt, Artificial Sequence
  Synthetic
gcucuguucugaagagaga

SEQ ID NO: 6277 - RNA, 19 nt, Artificial Sequence
  Synthetic
ugaagagagagcuggucag

SEQ ID NO: 6278 - RNA, 19 nt, Artificial Sequence
  Synthetic
gcaucguaucacagcaggu

SEQ ID NO: 6279 - RNA, 19 nt, Artificial Sequence
  Synthetic
cagcuaaacgcacugccau

SEQ ID NO: 6280 - RNA, 19 nt, Artificial Sequence
  Synthetic
acaagacguugacuuggau

SEQ ID NO: 6281 - RNA, 19 nt, Artificial Sequence
  Synthetic
gcugucaccuggaggcagc

SEQ ID NO: 6282 - RNA, 19 nt, Artificial Sequence
  Synthetic
cccaccagcuaaacgcacu

SEQ ID NO: 6283 - RNA, 19 nt, Artificial Sequence
  Synthetic
gcuucuacaauagccggcu

SEQ ID NO: 6284 - RNA, 19 nt, Artificial Sequence
  Synthetic
ugcaugcccucaucuaaug

SEQ ID NO: 6285 - RNA, 19 nt, Artificial Sequence
  Synthetic
cauaugucgccacaccuuc

SEQ ID NO: 6286 - RNA, 19 nt, Artificial Sequence
  Synthetic
gccucuauaccacccacuu

SEQ ID NO: 6287 - RNA, 19 nt, Artificial Sequence
  Synthetic
ggagcuguggcucccucag

SEQ ID NO: 6288 - RNA, 19 nt, Artificial Sequence
  Synthetic
ugaugguucagccaaacgc

SEQ ID NO: 6289 - RNA, 19 nt, Artificial Sequence
  Synthetic
uuuaccacucagagaagga

SEQ ID NO: 6290 - RNA, 19 nt, Artificial Sequence
  Synthetic
cauagugaaggcgaacugc

SEQ ID NO: 6291 - RNA, 19 nt, Artificial Sequence
  Synthetic
gggcaccaauaucaagucc

SEQ ID NO: 6292 - RNA, 19 nt, Artificial Sequence
  Synthetic
ugugaugguucagccaaac

SEQ ID NO: 6293 - RNA, 19 nt, Artificial Sequence
  Synthetic
guagaugggaucugcaugc

SEQ ID NO: 6294 - RNA, 19 nt, Artificial Sequence
  Synthetic
ccagaucuggcagcccauc

SEQ ID NO: 6295 - RNA, 19 nt, Artificial Sequence
  Synthetic
gaucugucaggugaagucc

SEQ ID NO: 6296 - RNA, 19 nt, Artificial Sequence
  Synthetic
aguucugaacaagacguug

SEQ ID NO: 6297 - RNA, 19 nt, Artificial Sequence
  Synthetic
cauacuguccaucaauauc

SEQ ID NO: 6298 - RNA, 19 nt, Artificial Sequence
  Synthetic
cugucugguuccauggcca

SEQ ID NO: 6299 - RNA, 19 nt, Artificial Sequence
  Synthetic
uaucagcuacuuguucuug

SEQ ID NO: 6300 - RNA, 19 nt, Artificial Sequence
  Synthetic
cugccagugacuaacagcc

SEQ ID NO: 6301 - RNA, 19 nt, Artificial Sequence
  Synthetic
agcagcugcacaaacaaug

SEQ ID NO: 6302 - RNA, 19 nt, Artificial Sequence
  Synthetic
uuccaucccuuccuguuua

SEQ ID NO: 6303 - RNA, 19 nt, Artificial Sequence
  Synthetic
accaucaucuuguucuuau

SEQ ID NO: 6304 - RNA, 19 nt, Artificial Sequence
  Synthetic
ccuaaagcuugcauuccac

SEQ ID NO: 6305 - RNA, 19 nt, Artificial Sequence
  Synthetic
gucgccacaccuucauucc

SEQ ID NO: 6306 - RNA, 19 nt, Artificial Sequence
  Synthetic
aucucugcuucuugguguc

SEQ ID NO: 6307 - RNA, 19 nt, Artificial Sequence
  Synthetic
cugagaguccaaagacagu

SEQ ID NO: 6308 - RNA, 19 nt, Artificial Sequence
  Synthetic
uucugcagcuuccuugucc

SEQ ID NO: 6309 - RNA, 19 nt, Artificial Sequence
  Synthetic
ugguacguacaauagcaga

SEQ ID NO: 6310 - RNA, 19 nt, Artificial Sequence
  Synthetic
augggagaauaaagcagcu

SEQ ID NO: 6311 - RNA, 19 nt, Artificial Sequence
  Synthetic
acauagcagcucguacccu

SEQ ID NO: 6312 - RNA, 19 nt, Artificial Sequence
  Synthetic
caggcucagugaugucuuc

SEQ ID NO: 6313 - RNA, 19 nt, Artificial Sequence
  Synthetic
uucgguugugaacaucccg

SEQ ID NO: 6314 - RNA, 19 nt, Artificial Sequence
  Synthetic
ugcuucuuggugucggcug

SEQ ID NO: 6315 - RNA, 19 nt, Artificial Sequence
  Synthetic
aacaauucgguugugaaca

SEQ ID NO: 6316 - RNA, 19 nt, Artificial Sequence
  Synthetic
ucuguucugaagagagagc

SEQ ID NO: 6317 - RNA, 19 nt, Artificial Sequence
  Synthetic
aauagcagacaccaucuga

SEQ ID NO: 6318 - RNA, 19 nt, Artificial Sequence
  Synthetic
ggauugccuuuaccacuca

SEQ ID NO: 6319 - RNA, 19 nt, Artificial Sequence
  Synthetic
agcugugguaguggcacca

SEQ ID NO: 6320 - RNA, 19 nt, Artificial Sequence
  Synthetic
ugcaugauuugcgggacaa

SEQ ID NO: 6321 - RNA, 19 nt, Artificial Sequence
  Synthetic
gauagucagcaccagggug

SEQ ID NO: 6322 - RNA, 19 nt, Artificial Sequence
  Synthetic
cagccaaacgcuggacauu

SEQ ID NO: 6323 - RNA, 19 nt, Artificial Sequence
  Synthetic
ugucaccuggaggcagccc

SEQ ID NO: 6324 - RNA, 19 nt, Artificial Sequence
  Synthetic
uccuagagugaaguaacuc

SEQ ID NO: 6325 - RNA, 19 nt, Artificial Sequence
  Synthetic
caaagggcaagauuucgaa

SEQ ID NO: 6326 - RNA, 19 nt, Artificial Sequence
  Synthetic
cgcacaagagccucuauac

SEQ ID NO: 6327 - RNA, 19 nt, Artificial Sequence
  Synthetic
aagagagagcuggucagcu

SEQ ID NO: 6328 - RNA, 19 nt, Artificial Sequence
  Synthetic
ugcaugguacguacaauag

SEQ ID NO: 6329 - RNA, 19 nt, Artificial Sequence
  Synthetic
gagcucgagucauugcaua

SEQ ID NO: 6330 - RNA, 19 nt, Artificial Sequence
  Synthetic
auccaugagguccugggca

SEQ ID NO: 6331 - RNA, 19 nt, Artificial Sequence
  Synthetic
ucaauaucagcuacuuguu

SEQ ID NO: 6332 - RNA, 19 nt, Artificial Sequence
  Synthetic
ucuuccucaggauugccuu

SEQ ID NO: 6333 - RNA, 19 nt, Artificial Sequence
  Synthetic
uuggcagaccaucaucuug

SEQ ID NO: 6334 - RNA, 19 nt, Artificial Sequence
  Synthetic
guggagaguuguaauggca

SEQ ID NO: 6335 - RNA, 19 nt, Artificial Sequence
  Synthetic
auuuacccuacccauacau

SEQ ID NO: 6336 - RNA, 19 nt, Artificial Sequence
  Synthetic
ucagaugacgaagagcaca

SEQ ID NO: 6337 - RNA, 19 nt, Artificial Sequence
  Synthetic
ucaauccaacaguagccuu

SEQ ID NO: 6338 - RNA, 19 nt, Artificial Sequence
  Synthetic
accagcccgaaggacagua

SEQ ID NO: 6339 - RNA, 19 nt, Artificial Sequence
  Synthetic
accauaacugcagccuuau

SEQ ID NO: 6340 - RNA, 19 nt, Artificial Sequence
  Synthetic
ucggcuggucagaugacga

SEQ ID NO: 6341 - RNA, 19 nt, Artificial Sequence
  Synthetic
uaucacagcagguuacaac

SEQ ID NO: 6342 - RNA, 19 nt, Artificial Sequence
  Synthetic
agccguuucuuguaaucuu

SEQ ID NO: 6343 - RNA, 19 nt, Artificial Sequence
  Synthetic
gcuuucuugguugccauaa

SEQ ID NO: 6344 - RNA, 19 nt, Artificial Sequence
  Synthetic
uggcagcccaucaacugga

SEQ ID NO: 6345 - RNA, 19 nt, Artificial Sequence
  Synthetic
caaauugcugcuguguccc

SEQ ID NO: 6346 - RNA, 19 nt, Artificial Sequence
  Synthetic
ccaucucauguuccaucau

SEQ ID NO: 6347 - RNA, 19 nt, Artificial Sequence
  Synthetic
cccauacauaucccaaaua

SEQ ID NO: 6348 - RNA, 19 nt, Artificial Sequence
  Synthetic
ugggagaauaaagcagcug

SEQ ID NO: 6349 - RNA, 19 nt, Artificial Sequence
  Synthetic
ucaaaucagcuugaguagc

SEQ ID NO: 6350 - RNA, 19 nt, Artificial Sequence
  Synthetic
ucaucuaaugucucaggga

SEQ ID NO: 6351 - RNA, 19 nt, Artificial Sequence
  Synthetic
ggacuugggagguauccac

SEQ ID NO: 6352 - RNA, 19 nt, Artificial Sequence
  Synthetic
cgccacaccuucauuccua

SEQ ID NO: 6353 - RNA, 19 nt, Artificial Sequence
  Synthetic
gagugaaguaacucuguca

SEQ ID NO: 6354 - RNA, 19 nt, Artificial Sequence
  Synthetic
ccagugacuaacagccgcu

SEQ ID NO: 6355 - RNA, 19 nt, Artificial Sequence
  Synthetic
aaguuuaauucugaaccau

SEQ ID NO: 6356 - RNA, 19 nt, Artificial Sequence
  Synthetic
cucugauaacaauucgguu

SEQ ID NO: 6357 - RNA, 19 nt, Artificial Sequence
  Synthetic
uagucguggaauggcaccc

SEQ ID NO: 6358 - RNA, 19 nt, Artificial Sequence
  Synthetic
ccacuuggcagaccaucau

SEQ ID NO: 6359 - RNA, 19 nt, Artificial Sequence
  Synthetic
cgcuggguauccugaugug

SEQ ID NO: 6360 - RNA, 19 nt, Artificial Sequence
  Synthetic
ucgccacaccuucauuccu

SEQ ID NO: 6361 - RNA, 19 nt, Artificial Sequence
  Synthetic
gcagacagauagcaccuuc

SEQ ID NO: 6362 - RNA, 19 nt, Artificial Sequence
  Synthetic
gaugagcuugcuuucuugg

SEQ ID NO: 6363 - RNA, 19 nt, Artificial Sequence
  Synthetic
cagggaacauagcagcucg

SEQ ID NO: 6364 - RNA, 19 nt, Artificial Sequence
  Synthetic
cuggauagucagcaccagg

SEQ ID NO: 6365 - RNA, 19 nt, Artificial Sequence
  Synthetic
cuagagcagacagauagca

SEQ ID NO: 6366 - RNA, 19 nt, Artificial Sequence
  Synthetic
uuccaccagcuucuacaau

SEQ ID NO: 6367 - RNA, 21 nt, Artificial Sequence
  Synthetic
  misc_feature (1)..(2): 2'-deoxy-2'-fluoro
  misc_feature (3)..(5): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(15): 2'-deoxy-2'-fluoro
  misc_feature (20)..(21): 2'-O-methyl
  misc_feature (20)..(21): phosphorothioate linkage
aagcaacugaacuagucguuu

SEQ ID NO: 6368 - RNA, 21 nt, Artificial Sequence
  Synthetic
  misc_feature (1)..(2): 2'-deoxy-2'-fluoro
  misc_feature (3)..(4): 2'-O-methyl
  misc_feature (5)..(5): 2'-deoxy-2'-fluoro
  misc_feature (7)..(7): 2'-deoxy-2'-fluoro
  misc_feature (8)..(11): 2'-O-methyl
  misc_feature (12)..(14): 2'-deoxy-2'-fluoro
  misc_feature (15)..(15): 2'-O-methyl
  misc_feature (18)..(21): 2'-O-methyl
  misc_feature (20)..(21): phosphorothioate linkage
aagcaacugaacuagucguuu

SEQ ID NO: 6369 - RNA, 21 nt, Artificial Sequence
  Synthetic
  misc_feature (1)..(4): 2'-deoxy-2'-fluoro
  misc_feature (5)..(6): 2'-O-methyl
  misc_feature (7)..(8): 2'-deoxy-2'-fluoro
  misc_feature (10)..(10): 2'-deoxy-2'-fluoro
  misc_feature (11)..(11): 2'-O-methyl
  misc_feature (13)..(13): 2'-O-methyl
  misc_feature (14)..(14): 2'-deoxy-2'-fluoro
  misc_feature (16)..(16): 2'-deoxy-2'-fluoro
  misc_feature (17)..(17): 2'-O-methyl
  misc_feature (18)..(18): 2'-deoxy-2'-fluoro
  misc_feature (20)..(21): 2'-O-methyl
uuucgaaucaauccaacaguu

SEQ ID NO: 6370 - RNA, 21 nt, Artificial Sequence
  Synthetic
  misc_feature (1)..(1): inverted abasic cap
  misc_feature (3)..(3): 2'-O-methyl
  misc_feature (6)..(8): 2'-O-methyl
  misc_feature (11)..(12): 2'-O-methyl
  misc_feature (16)..(21): 2'-O-methyl
  misc_feature (21)..(21): inverted abasic cap
cuguuggauugauucgaaauu

SEQ ID NO: 6371 - RNA, 21 nt, Artificial Sequence
  Synthetic
  misc_feature (1)..(2): 2'-deoxy-2'-fluoro
  misc_feature (3)..(4): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(10): 2'-O-methyl
  misc_feature (11)..(11): 2'-deoxy-2'-fluoro
  misc_feature (13)..(15): 2'-deoxy-2'-fluoro
  misc_feature (17)..(17): 2'-deoxy-2'-fluoro
  misc_feature (18)..(21): 2'-O-methyl
aagcaacugaacuagucguuu

SEQ ID NO: 6372 - RNA, 21 nt, Artificial Sequence
  Synthetic
  misc_feature (1)..(1): inverted abasic cap
  misc_feature (1)..(1): 2'-deoxy-2'-fluoro
  misc_feature (2)..(2): 2'-deoxy
  misc_feature (3)..(4): 2'-deoxy-2'-fluoro
  misc_feature (5)..(5): 2'-O-methyl
  misc_feature (6)..(7): 2'-deoxy
  misc_feature (8)..(9): 2'-deoxy-2'-fluoro
  misc_feature (10)..(10): 2'-O-methyl
  misc_feature (12)..(14): 2'-deoxy
  misc_feature (16)..(16): 2'-deoxy
  misc_feature (18)..(18): 2'-O-methyl
  misc_feature (19)..(19): 2'-deoxy
  misc_feature (20)..(21): 2'-O-methyl
  misc_feature (21)..(21): inverted abasic cap
acgacuaguucaguugcuuuu

SEQ ID NO: 6373 - RNA, 21 nt, Artificial Sequence
  Synthetic
  misc_feature (1)..(2): 2'-deoxy-2'-fluoro
  misc_feature (3)..(5): 2'-O-methyl
  misc_feature (7)..(7): 2'-deoxy-2'-fluoro
  misc_feature (8)..(8): 2'-O-methyl
  misc_feature (9)..(9): 2'-deoxy-2'-fluoro
  misc_feature (10)..(11): 2'-O-methyl
  misc_feature (12)..(15): 2'-deoxy-2'-fluoro
  misc_feature (20)..(21): 2'-O-methyl
aagcaacugaacuagucguuu

SEQ ID NO: 6374 - RNA, 21 nt, Artificial Sequence
  Synthetic
  misc_feature (1)..(2): 2'-deoxy-2'-fluoro
  misc_feature (3)..(4): 2'-O-methyl
  misc_feature (5)..(5): 2'-deoxy-2'-fluoro
  misc_feature (7)..(7): 2'-deoxy-2'-fluoro
  misc_feature (8)..(11): 2'-O-methyl
  misc_feature (12)..(14): 2'-deoxy-2'-fluoro
  misc_feature (15)..(15): 2'-O-methyl
  misc_feature (18)..(21): 2'-O-methyl
aagcaacugaacuagucguuu

What we claim is:

1. A double-stranded short interfering nucleic acid (siNA) molecule that inhibits the expression of CTNNB1, wherein the siNA comprises:
   5'-ACGACUAGUUCAGUUGCUU-3' (SEQ ID NO: 194) and 5'-AAGCAACUGAACUAGUCGU-3' (SEQ ID NO: 5107).

2. The double-stranded short interfering nucleic acid (siNA) molecule according to claim 1, wherein at least one nucleotide is a chemically modified nucleotide.

3. The double-stranded short interfering nucleic acid (siNA) molecule according to claim 1 further comprising at least one non-nucleotide.

4. The double-stranded short interfering nucleic acid (siNA) molecule according to claim 1, wherein at least one nucleotide comprises a universal base.

5. The double-stranded short interfering nucleic acid (siNA) molecule according to claim 1, having at least one phosphorothioate internucleotide linkage.

6. The double-stranded short interfering nucleic acid (siNA) molecule according to claim 1, comprising a cap on the 3'-end, 5'-end or both 3' and 5' ends of at least one strand.

7. The double-stranded short interfering nucleic acid (siNA) molecule according to claim 1, comprising one or more 3'-overhang nucleotides on one or both strands.

8. The double-stranded short interfering nucleic acid (siNA) molecule according to claim 1, wherein the 5' end of the antisense strand is phosphorylated.

9. The double-stranded short interfering nucleic acid (siNA) molecule of claim 7, wherein the 3'-overhang nucleotides on at least one strand are 2'-O-methyl nucleotides.

10. The double-stranded short interfering nucleic acid (siNA) molecule of claim 9, wherein the 2'-O-methyl nucleotides are linked with a phosphorothioate internucleotide linkage.

11. The double-stranded short interfering nucleic acid (siNA) molecule of claim 2, wherein the chemically modified nucleotide is a 2'-deoxy-2'-fluoro nucleotide.

12. The double-stranded short interfering nucleic acid (siNA) molecule of claim 2, wherein the chemically modified nucleotide is a 2'-deoxy nucleotide.

13. The double-stranded short interfering nucleic acid (siNA) molecule of claim 2, wherein the chemically modified nucleotide is a 2'-O-alkyl nucleotide.

14. A double-stranded short interfering nucleic acid (siNA) molecule comprising any of SEQ ID NOS: 6372, 6374, 6370, 6369, 2021, 2068, 6372, 6373, 2147, or 6368.

15. A composition comprising:
   (a) a double-stranded short interfering nucleic acid (siNA) having any of SEQ ID NOS: 6372, 6374, 6370, 6369, 2021, 2068, 6372, 6373, 2147, or 6368;
   (b) (13Z,16Z)—N,N-dimethyl-3-nonyldocosa-13,16-dien-1-amine;
   (c) cholesterol;
   (d) DSPC; and
   (e) PEG-DMG.

16. The composition according to claim 15, wherein the (13Z,16Z)—N,N-dimethyl-3-nonyldocosa-13,16-dien-1-amine, cholesterol, DSPC, and PEG-DMG have a molar ratio of 50:30:10:2 respectively.

17. The composition according to claim 15, further comprising sucrose, trehalose, or any combination thereof.

* * * * *